United States Patent 11,149,254 (CLONAL STRAINS OF ATTENUATED VACCINIA VIRUSES AND METHODS OF USE THEREOF) - sequence listing, part 2

SEQ ID NO: 192 - DNA, 191737 bp, Vaccinia virus
  Vaccinia virus Copenhagen
gtaaaattaaattaattataaaattatgtatatgatttactaactttagttagataagttagtaatacataaattttagtatattaatattatattttaaatatttatttagtgtctagaaaaaaatgtgtgaccaacgaccgtaggaaactctagagggtaagaaaaatcaatcgctttatagagaccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagactccatcagaaagaggtttaatatttttgtgagaaaggagaaagagataaaacttttttacgactccatcagaaagaggtttaatatttttgtgagaaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttgtgagaccatcgaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtaacgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagccagagcttcttcacgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcacatgcatgccaggacgatatattgtttcataattgctattgattgagtactgttctttatgattctacttccttaccatgcaataaattagaatatattttctacttttacgagaaattaattattgtatttattatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatatacagtctccgaatgcggcatgataccgtcatcattctttgctttcgttaactgtttggaggaagaatctttgttattgcatttaatctcgaaattcagagtgcacacctttctcctgtaaagaatcctgaagtcgctaccttattaagaacggagaagtatccatcacgaaatacgggattacagtctttatgattcatagtaatagttagttccgacgttgagatggattcactgagaccggtagtggtcgtccgagtacacgacgtgtcgttgacgggatacagattaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtagtgttacacgatcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcataatttaataatgtagtaatcgttgtcgtgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgtctgtccgaatgtatggcttcaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagaattctgacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtatatgtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagttcatcctcgtcggcgcaattagggtcggatcctttgtacagaacgtagtagtttaagctcccattgaatttatatctaagataacacagcaatagatcggatgatttactaaagtcatcaatggtgtccgttagtatatcaaagatcttgttatcgattgatagtgaatgaatcagatagtggtgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgctcacaatctcgtccatctcgcccatctcatacatttcatcatttactttttcataattagagatgtacgaaagaaaaagaaaaagaaaaagaaaaacagaacaatatatttttttagtaatgtttatgcgagacatataaaataaactccgtgtttatgatgccggtaaatgtttttatcatcttggacggaatcgattttgtaatatgtcatggaaacaaatgaaacaggacattatcactccatgataaattatttaatggagtaataaagtatctccatgggtaatttcgaaatcaagttatcgtctgtattaatgttgtccactatggagtcgatcctctcactgttctttacagtttctgtaatgatggacgttagttcttttttgtaccatttgatgtcggattctttgcgtatctcagtctgtggcgtttgcttcgtttaaataatatatcaaacatggagacgcctgatatgtaggcattcttcattctattaatgtctactctatagcgctttagttccttatgatgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtagctaagtaataaatcaactatcctcgttttgttttctctttggtaactgcttttctggatggccgtattgattatcgagcgtgatgttgtaacactcgctccatattccaataaccgctttgcaaattgtatattattgacatcgaccgcgtaatatagtagagttttattctcattatcgatcatatctatatcatccatgtacttgcttagtatatcaaatacatctattagtatggtttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttattgatcaaacatttaattacatccttggatagagattgagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaagacagatcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatctctagttttatttttttgtacgtcacatcttcatccagtagacgacatagaatagtgcactctctaccacaataatccatagctattctggtgctaattattcctatttcacgaaaaatgatgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcgatattgtcccacggaagtgaatccttcaactcaccaccaaagagctccgttgcatcagttctgaaagagatgagaagcctgtagagagaccctgcgctttctctatgggtccatctatgagaaacccacaggatgtattcagtcagacaatgtctgacgtcggccacggtattcagggagtccttagtagcgtggcaatgacagggtctgaactgggcacaaggaaaggccattgtaaaggtagacctgtagccgtttatgctaatagagggctttaatttccatttttttaatgggttgtggatgaggaatgagagtgatatcatattgagatacgtagttatgtagaggtgtatttcctatattatttactttcggtttcatattttaccaactctttaataaatttcttttcacgatgcatcttattgaatgacgttttctcataagtggacatatagatgcagaagtaatgaagaaaagtattacctctatcatctacataattagggtctgctcctttttttaacaacttatacagtacgtagtagtagtttatcggttttaaatcaagtctagaatatatagtggattaatatatttttatattagctaaagctatctatactatcagaaagcatatcattctcaacttcatcatgagttaaatatttgtgtaatggatgtcatgaacattaaacgtattcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcattaaacatctttgcatcatactcgcatagcatagtttttcataattaatacaatatttaaaagacttattcggaaagtattttaatacatgtatcatcgatggagatccatatgaggagtcacttgtagttcttcagtagtaataacagtgctatcatcgatagtataattatatgtagaaggttcatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagatatatagccagagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaacccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtccagtctttggtatcgatagtgtagttattgaactgagaagttaccgtatagtctttttggtcatctctaaacaaggaaactaatacctctacactattgaacgatttatcttccgtaatgggtggactagcgatggatgaagtcacgaatataagacacgctattaatccgtatatcatcattttgatattacttataataacgatttgtttaatttttagtttatactattaattgtaaatgatattattatttttttaagtattatcagctttagtttatactattactatttgtaatatttagacatagataaacgtgataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataatcaccatactagagtttccctcgtatggaatatcgataatagagaatcctccgaataattcattaatatgtacatattgcaagttattctcggtacccaccatcatatcaacactggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacgtccatgtcattattgtcatcgggtgtattctcattcatattctctatatattttgatagttgttcagctgtagaaccagctgctccatgatttagaatagataaagtagataaaatagaaactggagaaatcaaaacattttcatcagggtgttttacgattagttctttaaagatatccatggtatagaccaaacaataacgataacgatatatatcataaataaataatgttaaatttcagtttatgtttgtaccccgtattcatacttaacaaattggtattgcgtacacaatcaatcatattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgttataaacacacactgagaaacagcataaacacagaatccatcaaaaatgtcgatgaaatatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattattacgtgttgtctattatctgtttataggttcactcgaagaactaataaactacctctacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcagcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatattaacgtcgtcgttgtagtgaatagtagttattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcagaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacatatattattagaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacagtatgttggtaacgacaaataccgatcggtaattgtctgccggtgtaatagaattatatatatctatctattacaccggctgagtacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggaatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaaactgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtatcatcgttaggatttggtaaatcattatctacagtgtatggtactagatcctcataagtgtatatatctagagtaatgtttaatttatcaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgcttccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgtcctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcggaacatcaattattacggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatatcacgctttccattcttgaagtactataagtaattatagtataatgtaaaggtttatatattcaatattttttataaaaaaatcatttcgacattaattcctttttaaatttgcgtctatcatctatagaaacatattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcatacggggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattgtttagttcatccttgttcattgttaggaatctattcaaaatggcaattatactagaactataggtgcgttgtatacacatattgatgtgtctgtttatacaatccatgatatttggatccatgctactaccttcgggtaaaattgtagcatcatataccatttctagtactttaggttcattgttatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtttatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatagcatcttcacaaattatatcattgtctaatagatatttgacgcatcttatggatcccacttcaacagccatcttaaaatcggtagaatcatattgctttcctttatcattaataatttctagaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcagacttgtattcaacatgcttttctataatcatcttagttatttcggcatcatccaatagtacattttccagattaacagagtagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtggtgtgaatacaactaaggagaatagccagatcaaaagtagatggtatttctgaaagaaagtatgatacaatacttacatcattaagcatgacggcatgataaaatgaagttttccatccagttttcccatagaacatcagtctccaatttttcttaacaaacagtttcaccgtttgcatgttaccactatcaaccgcataatacaatgcggtgtttcctttgtcatcaaattgtgaatcatccattccactgaatagcaaaatctttactattttggtatcttctaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttccaccgtatccataaacaatattaaggagattctaccttacccataaacaatataaatccagtaatatcatgtctaatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgcaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatgtacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacaacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatgtatagagcataatccttctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatctatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctgaaacatcactaatctcattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggatactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatccccgtagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacaaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcattgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactagataaatcgtttgcgagattgttgtgggaagcgggcatggaggatgcattatcattattatttaacgccttccattcggattcacaaatatggcgcgcgttcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgacgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttattcttattcttattcttattcttattcttattcttagcgtcacagaatctaccacagcagaatcccatgacgagcgtcatattaaactaattcattttcaattataatatacgattagtaatgaccattaaaataaaaaatattcttcataaccggcaagaaagtgaaaagttcacattgaaactatgtcagtagtatacatcatgaaatgatgatatatatattctctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtggtcgccgactatcgtgtttgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttcagcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtctagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttagaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaaaactataccatatcctcctgtagatatgtgataaaaatcgtcgtttataggataaaatcgtttatccttttgttggaaaaatgatgaattaatgtaatcattctcttctatctttagtagtgtttccctattaaaattcttaaaataatttaacaatctaactgacggagcccaattttggtgtaaatctaattgggacattatgttgttaaaatataaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaacacctccacagtttttaatttctttggtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgtcagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccgggtacgtggatatcatatatggtattggtccattatcagtaatagctccataaactgatacggcgatggtttttatatgtgtttgatctaacgaggaagaaattcgcacccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatatcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtatttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactagaccgatgaccatttaaaaacccctctctagctttcacttaaactgtatcgatcattcttttagcacatgtataatataaaaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaacccacgtaacattggaattaactatcgatagtaatgcatcgacgcttccaaaattgtctattataaactcaccgataatttttttattacatgttttcatattcattaggattatcaaatctttaatcttactacgattgtatgcgttgatattacaagacgtcattctaaaagacggaggatttccatcaaatgccagacaatcacgtacaaagtacatggaaataggttttgttctattgcgcatcatagattcatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatcgtacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccgtccagatgcgagagaatgaataaccctggaaaacaagtcccgtttatgaggacggacatgctacaaaatatgttcgcggctaatcgcgataatgtagcttctagacttttgaactaaaatacaattatatctttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatagttgccatacgtgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattattgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttttgaatatttctagcttgtaattttaacatatgatattcattcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactaaacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagttaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgctatcgcattgtcctcgtgcaaatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatgtctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactgaacctactttatcatttttttattcatcatcctctggtggttcgtcgtttctatcgaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaatgaaaatggataagaagaggacaaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctcttcatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatcgtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtaaacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttggtatatacatagatattaattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcatagccaatggatcgttctctggtagatacgtatcatatcttcgaaagttttctgctcttccaacaaacgagtttattagttttttattattgacctccatccctatctataatatcttattctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaatatgtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgataaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactattgctatagaggacaataatgtcatgtctagcgatgatctgaattatatttattattttttcatcagattatttaacaatttggcatctgatcccaaatacgcaatcgatgtgtcaaaggttaaacctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtttaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacatctggaacaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatgtcggagttaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacgagatctacaggaatgcgtacttcaggtttcttagcttgtgattttttcttttgcggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagccgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtaaaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccagataatgttctctttgataaaagttccagaaaatgtagaattttttaaaaagttatcttttgctattaccaagattgtgtttagacgcttattattaatatgagtaatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaatttcttgacgctagtggagttgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccatttttccatacgtttatattcttttaatcctgcgttatccgtttccgttatatccagtgatagatcgtgcaggttaaatagaatgctcttaaataatgtcatttttttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccacgaaacaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaattcaaatagatgttcatcatataatcgtcgctataattcatattaatactttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcattgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactttgcgagatttagtttatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgtcaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgactgttataaaaatgccggtgttgaaacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttcccacgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctagcattctagagcattccatgatctgtttatcgttgatattggccggaaagatagattttttattttttattatattactattggcaattgtagatataacttctggtaaatatttttctaccttttcaatttcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggccattatacctctcagtgcatcagtgttctaccgaggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaataaggaactgatgcctattaggacagatactactatttgtctaagtatagatcaaaagaaatcttatgtgtttaattttcacaagtatgaagaaaaatgttgtggtagaaccgtcattcatttagaatggttgttgggctttatcaagtgtattagtcagcatcagcatctggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcagcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtaaaacaaacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgactactaaggccactactcaaatagcacctagacaagttgctggtacaggagttcagttttatatgattgttatcggtgttataatattggcagcgttgtttatgtactatgccaagcgtatgctgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatttcacaactttactgtttttaagctgttcaaaatatagcatcgatccatgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcatcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactctcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggaatgattatcaaatggatgctaattgacggacgccatcatgatcctattctaaatggattgcgtgatgtgactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgttgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacacttccagtatcaatttatcatatattacatccggcaaaaataatatgattagaagttatattgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttagaatacaagatctttgtttagatgaagtattgaacatcttggggaaatatggaagaaagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttatattcttaattctttaacaaaaggattaacaggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacctgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcgatgactccttatttttagacattagatatgccaaaatcatagccccgcttctatttactcccgcagcacaatgaaccaacacgggctcgtttcgttgatcacatttagataaaaaggcggtcacgtcgtcaaaatatttactaatatcggtagttgtatcatctaccaacggtatatgaataatattaatattagagttaggcaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtaaacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacaaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggtatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattctactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcggcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaagaggcattaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtataaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatacgctgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaatcgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagttatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtgggatatcatccagcggctagagaccgccaattcgagaaagatagatcatttgaaattatcaacgttttactggaattagacaacaaggtacctataaattgggctcaagggtttatttattaatgctttagtgaaattttaacttgtgttctaaatggatgcggctattagaggtaatgatgttatctttgtccttaagactataggtgtcccatcagcatgtagacaaaatgaagatccaagattcgtagaagcatttaaatgcgacgagttaaaaagatatattgataataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagactatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgataatattaaaaagttgacagaaccttgtgtcattggaagaccgtgtttctccaataaaattaataatagaaaccatgctacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagatttgcatttctatacttgttggtgaaatggtacaaaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaattatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaacggcagtattgggacaacttaatctgatgaataatttagatactttatttcaggaacaggataaggaattgtacccaaatctgaaaataaataatggcgtgttatacggagaagaattggtaacgttaaacattagttccaaatttaagtactttatcaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaacctcatgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataagaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatacggttttccatcatgattagacgacgacaatagtgttctaaatttagatagttgatcagaatgaatgtttattggcgttggaaaaattatccatacagcgtctgcagagtgcttgatagttgttcctagatatgtaaaataatccaacgtactaggtagcaaattgtctagataaaatactgaatcaaacggcgcagacgtattagcggatctaatggaatccaattgattgactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcacttcgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgtccaaacaggaaagaagtatactatcgtcatttttttctctatatccagctactgctgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccaagtcatatctagaatgaagatatcattgattgagaagaagctaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatttcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattgacgataggtgtagccgataaacaaatcatcttatggttttttaacgcaatggttttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatacttttcgaatcagaagtcatactagaataaagcagcgagtgaacgtaatagagagcttcgtatactctattcgaaaactctaagaacttattaatgaattccgtatccactggatcgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagtaacacgttttttagatctcatatgtgctaaaaagttttcccatactaattggttactattatttttcgtataatttttaacagtttgaggttttagatttttagttacagaagtgatatcgaatattttatccaaaaagaatgagtaattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacacgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccatcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaacgatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcagtctagtatacatagagttaagagagattagagtttgtacattaagcaacatgtctctaaatgtggctacaaacttttccttttccacatcatctagtttattatataccgatttcacaacggcaccagatttaaggaaccagaatgaaaaactctgataactacaatatttcatcatagttacgattttatcatcttctatagttggtgtgatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacatatttagacgacagatcttcgttaaaaagttttccatctatgtagaatccatcagttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcaatttgatgaacacacgatgaaaatgtacttcgatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataatgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctgaccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcagaacttccaataaaattacttaaagatagaaatgaattatttacaaaattcattaacgagttaaaaaagaccagttcattcaagataagcaaacgcgataaggatacgctattaaaatattttacttaggactggagttagaatttatagacgactcatttcgtttatcattattactaccatcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccattttacacgatgattgcctcaagtctccaatcgtttgtttagaacgattagctacagagttcaacgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatacaaaagttcataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagtgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtattatcaaagttaagatctgggtatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaaagagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaacattatcgagcaagcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggaggttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatacagaagatttaactagattatacaatgaactaatatgatccttttccagattatttacaaacttggtattttttggttctggaggaggcgaatttaaattcggacttggattcggattttgtgagttcttgatcttattatacatcgagtataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatagatataaaatagaaaataacagatattacaaccaatgttatggccgcgcccaaccaggtaggcagttttattttatcttttactacaggttctcctggatgatgtacgtcaccaacggcggacgtagttctagtacaattagacgtaagttctgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaatttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccagctaaccgaatttattgtaacagtattattaatattgccaagttatccgatctaaaaaaaactatctatgcggtagatagtttttttgagccatattccacagataatattagacatatgataaaacgattagatggaccatctaataaatatcatatatatactgagaagttattatctgtagacgagcctagaaatcaacttattcttgataccctggtagaagaattcaagtcaggaactattaatcgaattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacttcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttagacggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatagaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctaggaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgaatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgatgagtatctgagtactacagttagatccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtacttacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagcttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgatatgacattctctgacattcagaaagagtttccacatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaatgcatattcgaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaagcgaatgagggacgaaaacgtggaggaggtattaagtttggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagatttcaattcacgttcgcatgggttacctccgcagtttttacgagcgatttcacgttcagccttcatgcgtctctgtgatccgtttacgttaaaccataaatacatgggtgatcctataaacatgaatttatttctaattctcagagctatagttaattgaccgtgtaatatttgcttacatgcatacttgatacgctcattaataagatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggagctcctaatggagattttctattctcgtccattttaggatatgctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttatcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaatcacctaccttaatcatgtgattatgaatattggctattagagcaccttctaagaaatctataatatctttgaaacacgatttaaaatcaaaccacgaatatacttctacgaagaaagttagtttacccataggagagataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagctgatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagtaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcatatcgtgatataaataacatttattatcatgatgacaccagaaaacgacgaagagcagacatctgtgttctccgctactgtttacggagacaaaattcaaggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtatgtttaagaagttgtcggtgccggccgctataatgatgatactctcaaccattattagtggcataggaacatttctgcattacaaagaagaactgatgcctagtgcttgcgccaatggatggatacaatacgataaacattgttatctagataccaacattaaaatgtccacagataatgcggtttatcagtgtcgtaaattacgagctagattgcctagacctgatactagacatctgagagtattgtttagtattttttataaagattattgggtaagtttaaaaaagaccaataataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatttcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggattataattgatgggaaatgcaatagtaattttttatcataaaagttgtaaagtaaataataaaacaataaatattgaactagtagtacgtatattgagcaatcagaaatgatgctggtacctcttatcacggtgacagtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattccccatagactatcgactattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtgtattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaagatcaaggattatatggaacacgattattataaaataacaatagttcctggttcctcttccacgtctactagctcgtggtattatactcatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattctataatcaatgagacatcactatccgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatatcacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagttacaacgaatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgtttcacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccacacgacaatgaacaaacctaagacagattatgctggttatgcttgctgcgtaatatgcggtctaattgtcggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatacatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaacagtatgaaaattaagaaaacagtttaatagatcaacagaaatatttaatcctccgtttgatacagatgcgccatatttatggatttcggattcacacgttgtttgtctgaggggttcgtctagcgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacaccaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatactatctataaacataagtatataataaatactttttatttacggtactcttgtagtggtgataccctactcgattatttttttaaaaaaaaaatacttattctgattcttctaaccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgtaccgcgttatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtgaagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagcgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagaaaacacagaaatccgtccaagagataaaagcattttaactttagaagacgtggatagtttcttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggtaactaaatgttccggtcacgatgataatacgttaagggttttgcaagaccaattaacgatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaagagtttgtgaaaaagttaagaacgttcacattggcggacaatctaaaaacaatacagtgattgcagatttgccatatatggataatgctgtatcggatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatataaagtagccattcttcccatggatgtttccttttttaccaaaggaaatgcatcattgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtctactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagctattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatcccaattattctaatggatgtcatcaatgtagaaaatgcccaacaggatcatttgataaggtaaagtgtaccggaacacagaacagtaaatgttcgtgtcttcctggttggtattgcgctactgattcttcacagactgaagattgttgaaattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaaggaatctacaggcataaaaataaaaatataatttataatatactcttacaacgccatcatgaataacagcagtgaattgattgctgttattaatggatttagaaatagtggacgattttgtgatattaatatagttattaatgatgaaaggataaacgctcataaactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaatcatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcgtgataaaatttccataaactgctacaatcataaaaaaaatacatgggaaatgatatcttcacgtagatataggtgtagtttcgcagtggccgtcctggataatattatttatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgataaatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccagaaactagttctgagaaacctgattatatagataattctaattgctcgtcggtattcgaaatcgcgactccggaaccaattactgataatgtagaagatcatacagacaccgtcacatacactagtgatagcattaatacagtaagtgcaacatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccatcaactactgtaggtagtagtacaacctctattagtaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatttaaacatcgacggtgttagaagttttaaaaatacttacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattattattgaagatgatgtgaatttagcatatagtaagttaattcagatactacaggaccgtattagaatgtattttaacactaattaaagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatagattcttggtaattaatagattaggtgtagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtacacttagtccaggacctataattgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaaacatacatctgtttcagctaagcaactaagaacacgtatacggcagcagcttcctttatactctcatcttttaccaacacaaagggtggatatttgttcattggagttgataataatacacacaaagtatttggattcacggtgggttacgactacctcagactggtagagaatgatatagaaaagcatatcaaaagactttgtgttgtgcatttctgtgagaagaaagaggacatcaagtacgcgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataggttgtaatatcatatagacaataactaacaattaattagtaactgttatctcttttttaactaaccaactaactatatacctattaatacatcgtaattatagttcttaacatctattaatcattgattcgcttctttaattttttataaactaacattgttaattgaaaagggataacatgttacagaatataaattatatatggatttttttaaaaaggaaatacttgactggagtgtatatttatctcttcattatatagcacgcgtgtgttccaattcttccacatcccatataatacaggattataatctcattcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactgtccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccgtactcccaatatgtgtacgaactaacgaagaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataattaataattaataattaataacgaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctgaagaaccagtaacatatgatatcgatgactacgattgcacgtctacaggttgcagcatagactttgccacaacagaaaaagtgtgcgtgacagcacagggagccacagaagggtttctcgaaaaaattactccatggagttcggaagtatgtctgacacctaaaaagaatgtatatacatgtgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatacagatacagatacagatacagatacagatacagatacagatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgtgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaattatattctttttttatagagtgtggtagtgttacggatatctaatattaatattagactatctctatcgcgctacacgaccaatatcgattactatgaatatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccataaataaagtatatgggcgatattctgccgtgtttaaagatttctttttgggaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatcaccaacggaaatggtagatgtaagtatgatgtctatgtacggcgagctatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccaacaactaattgttaaccattttttttaaaaaaaatagaaaaaacatgtggtattagtgcaggtcgttgttcttccaattgcaattggtaagatgacagccaactttagtacccacgtcttttcaccacagcactgtggatgtgacagactgaccagtattgatgacgtcaaacaatgtttgactgaatatatttattggtcgtcctatgcataccgcaacaggcaatgcgctggacagttgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttcttctttcttctcttctccctttcccagaaacaaacttttttacccactataaaataaaatgagtatactacctgttatatttcttcctatatttttttattcttcattcgttcagacttttaacgcgtctgaatgtatcgacaaagggtaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagattttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataatacatcctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcaaactttgaagaatttatataaatcattccatcgatacatccttctatgttgacatgtatatatccaggaattcttttattaatgtcaggaaatgtataaactaaaacattgcccggaagcggagcttctaccggagttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggaatctaacgcacatcgtcgtacgtttacacaattgtgatttagtgtagtatatctacacatgtatttttccgcgctatagtattctggactagtgataaaactatcgttatatctgtcttcaatgaactcatcgagatattgctctctgtcatattcatacacctgcataaactttctagacatcttacaatccgtgttattttaggatcatatttacatatttactggtataaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatcaactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtcctgcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgttcgataaatacgatggtataataactaaatgtcacgacgaaacaatgttactcaaactgtccactgttctagacactacactatatgcagttttaagatgtcataattcgagaaagttaagaagatacctcaccgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatggccactctaggagagccattcagtgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatgattatgatagaactggtatgaacagcgagagcgatagtgagagtgataatatatcaatcaaaacagaatatgagaatgaatatgaattctatgatgaaacacaagatcaaagtacacaacacaatgacttataaaaatactaaaactggagagactgattacacgtacctctctaatgggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaactcatgatgaagttgagaatgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcattcaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattattgtggtagagagtgcactattctatgtcgtctactggatgaagatgtgacgtacaaaaaaataaaactagagattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgatctgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaaaccatactaatagatgtatttgatatactaagcaagtacatggatgatatagatatgatcgataatgagaataaaactctactatattacgcggtcgatgtcaataatatacaatttgcaaagcggttattggaatatggagcgagtgttacaacatcacgctcgataatcaatacggccatccagaaaagcagttaccaaagagaaaacaaaacgaggatagttgatttattacttagctaccatcccactctagagactatgattgacgcatttaatagagatatacgctatctatatcctgaaccattattcgcctgtatcagatacgccttaatcctagatgatgattttccttctaaagtaagtatgatatcgccggtcatcataaggaactaaagcgctatagagtagacattaatagaatgaagaatgcctacatatcaggcgtctccatgtttgatatattatttaaacgaagcaaacgccacagactgagatacgcaaagaatccgacatcaaatggtacaaaaaagaactaacgtccatcattacagaaactgtaaagaacagtgagaggatcgactccatagtggacaacattaatacagacgataacttgatttcgaaattacccatggagatactttattactccattaaataatttatcatggagtgataatgtcctgtttcatttgtttccatgacatattacaaaatcgattccgtccaagatgataaaaacatttaccggcatcataaacacggagtttattttatatgtctcgcataaacattactaaaaaaatatattgttctgtttttctttttctttttctttttctttcgtacatctctaattatgaaaaagtaaatgatgaaatgtatgagatgggcgagatggacgagattgtgagcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacaccactatctgattcattcactatcaatcgataacaagatctttgatatactaacggacaccattgatgactttagtaaatcatccgatctattgctgtgttatcttagatataaattcaatgggagcttaaactactacgttctgtacaaaggatccgaccctaattgcgccgacgaggatgaactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatacatataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtcagaattctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttgaagccatacattcggacagacacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacacgacaacgattactacattattaaattatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagacgcgatcgtgtaacactactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaatctgtatcccgtcaacgacacgtcgtgtactcggacgaccactaccggtctcagtgaatccatctcaacgtcggaactaactattactatgaatcataaagactgtaatcccgtatttcgtgatggatacttctccgttcttaataaggtagcgacttcaggattctttacaggagaaaggtgtgcactctgaatttcgagattaaatgcaataacaaagattcttcctccaaacagttaacgaaagcaaagaatgatgacggtatcatgccgcattcggagactgtatatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcatggtaaggaagtagaatcataaagaacagtactcaatcaatagcaattatgaaacaatatatcgtcctggcatgcatgtgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcgtgaagaagctctggctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgttacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctcttcgatggtctcacaaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctcctttctcacaaaaatattaaacctctttctgatggagtcgtaaaaaagttttatctctttctcctttctcacaaaaatattaaacctctttctgatggagtctccttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctcctttctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggtctctataaagcgattgatttttcttaccctctagagtttcctacggtcgttggtcacacatttttttctagacactaaataaatagtaaaattaaattaattataaaattatgtatatgatttactaactttagttagataagttagtaatacataaattttagtatattaatattatattttaaa

SEQ ID NO: 193 - DNA, 8 bp, Artificial Sequence
  NotI restriction site
gcggccgc

SEQ ID NO: 194 - DNA, 3689 bp, Arabidopsis thaliana
  PEPR-1
atgaagaatcttggggggttgttcaaaattcttctgcttttcttctgtctctttctatcgacccacataatttccgtttcttgtttaaactcagatgggctaactctactctctcttctgaagcatttggatagagtaccaccacaagttacttcgacatggaaaataaacgcatctgaagcaactccatgtaactggttcggtatcacttgtgacgattctaagaatgttgcgtctctcaacttcactcgttctagggtttcaggtcaattgggtccggaaattggggagctcaaaagcttgcagattttggatctgagtactaacaatttctccgggactataccttccactttaggaaactgtaccaaactcgctactctagatttgtctgaaaatggattctctgataagatcccagatactctcgatagcttgaagaggttggaggtgctttatctttacataaacttcctcactggtgagttacctgaatccttgtttcgaattccgaagctgcaggttttatatcttgactataacaatctcaccggtccgattcctcaaagtattggtgatgctaaggagcttgtggagctgagtatgtatgcgaatcagttctctggtaacatccctgagtcgattgggaatagcagtagtctgcagattctttatttgcacaggaacaagttagttggttcattacctgaaagtctcaatcttttggggaatctcactactctgtttgttggtaacaacagtctacaagggccggttcgtttcggatcacctaattgcaagaatttgttgactttagatttgtcatacaatgaattcgaaggcggtgttccacctgcattgggaaattgcagtagccttgacgctttagtcattgtgagtggtaacttgtcaggtacaatcccttcctcattgggtatgttgaagaatctcacaattcttaacctttccgagaatcgtctctctgggagtatccccgcagagctcgggaactgcagtagcttgaacttgttgaagctgaacgataaccagcttgtaggcggaataccgagtgcattaggtaagctgaggaagctagaaagtctggagcttttcgaaaaccggttttcgggtgagattcctattgagatatggaagagtcagagtcttacgcagttgctagtttatcaaaacaatctcactggtgaactacctgtggaaatgactgagatgaagaagctaaagatcgctacgctgttcaacaacagcttttatggagcgataccaccgggtttaggtgtgaacagcagcttagaagaggttgactttattggtaacaaacttacaggagagataccgccaaatctatgccatggaaggaagttgagaatactcaacttgggttctaatctgcttcatggtacaataccagcttctattggtcactgtaagaccatcaggagattcatccttagagaaaataacctttcaggtcttcttcctgagttttctcaggatcatagtctttcttttcttgatttcaatagcaacaacttcgaaggaccaatcccgggcagcctcggaagctgtaagaatctctcgagtattaacctatctcgaaacagattcacggggcagatacctccacaacttgggaatctacaaaaccttggttacatgaatctttctcgtaatcttcttgaagggtctctaccagctcagctatctaactgtgtgagtttagagcgttttgatgttggcttcaactcattaaacggttcagttccttcaaactttagtaactggaaaggcttgacgactttagttctcagcgagaaccggttttcaggaggtattccacagttcttgcctgagcttaagaagctgtcaactctgcagattgctagaaatgcttttggtggtgagattccttcgtcgattgggttgatagaggatctgatctatgacttggaccttagtggaaacggattgacaggtgaaattccagccaagttgggagatctcatcaagttaacaagactcaacatatctaacaacaatttgacaggatctttatcggttctcaaaggtcttacctcattgctacatgttgatgtctccaacaatcagttcacaggtccaataccagataacttggagggtcagttgttatctgagccgtcgtcgttttcaggaaatccaaacctctgcattccacattccttctctgctagcaacaatagccgcagcgcgttaaagtactgtaaagatcaatctaaaagcaggaagagtggccttagcacctggcaaatcgtgctaatagcggtcttatcgtctttattagtcttggttgtggtccttgctcttgttttcatttgcctacgtcgtcgcaaaggaagaccagagaaagatgcttatgtcttcactcaggaggaaggcccatctttgttgttgaacaaagttcttgcagcaactgacaatctaaatgaaaagtacaccattggaagaggagctcatggaattgtgtacagagcttctttaggctccggaaaggtctacgctgtgaagagacttgtattcgcgtctcacatccgcgctaaccagagtatgatgagggagattgatacaatcggtaaagtcaggcacaggaatctgattaagttagaagggttttggctgaggaaagacgacggtttaatgctgtatagatacatgccaaaaggaagtctttacgacgttctccacggtgttagcccgaaagaaaatgtgctagactggtctgcacggtacaatgtagcacttggtgtcgctcatggactagcctatctacactatgactgccatcccccgattgttcaccgtgacatcaaaccagagaacatactcatggactcagatttggagcctcacattggggatttcggtttggctcgccttcttgatgactcaacggtttcaactgcaactgttacaggcaccaccggctacattgcaccaggtaatgcatcttctcattatacatagtggacttggtataatctggtttagtgttcaaaccgagttagttaccggttaaaaaagtctgttaggaagatactctgtttcttattagctaatttcacaattaaactgcagaaaacgctttcaaaaccgtgaggggaagagaatcagacgtttacagttatggagtcgtgttacttgagctggttacgaggaagagagcggtggacaaatctttcccggaaagtacagatatagtaagctgggtgagatctgccttgagcagcagcaacaacaatgtggaggatatggtaacaacaatcgtcgatccgattctcgtggacgagcttctggattcgagtcttagggagcaggtgatgcaagtgacggaactggcactgagttgtacacagcaagatccggcaatgagaccaacgatgagagatgcggtgaaactgttggaagatgtgaaacatctggcaagaagctgctcctctgattcagttcggtaatctcgttactttgtgcagagcagaaggaggaaactaaaggactgttatcagtggtaacgtaactgggcttaccggtaatgtaactgggccaataatgtaaaatatggcttattgaaggcccaaatatgacggccctttaattgtaaccgtgtttgtttgtgaaataaaatctcgtttatc

SEQ ID NO: 195 - DNA, 1862 bp, Homo sapiens
  Human alpha 1A amylase, transcript variant 1
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 196 - DNA, 4252 bp, Homo sapiens
  Human alkaline phosphatase
tcagccagtgtggcttcaggtcaagaggctgggcagggtcaaggtggcaacgaggggagaagccgggacacagttctccctgatttaaacccgggcagcctggagtgcagctcatactccatgcccagaattcctgcctcgccactgtcctgctgccctccagacatgctggggccctgcatgctgctgctgctgctgctgctgggcctgaggctacagctctccctgggcatcatcccaggtaatgaggctccccgagctgcccctacacaacacacacacagggcaccccccagcccaggctgacctgatttttgctctccccctggccagttgaggaggagaacccggacttctggaaccgcgaggcagccgaggccctgggtgccgccaagaagctgcagcctgcacagacagccgccaagaacctcatcatcttcctgggcgatggtgagtgagccaggccttccagccctgcagccctcacagccccggcgcccggaccctcagtggttccaggagagccctggggcccaagcctcacacatttctgttccttcagggatgggggtgtctacggtgacagctgccaggatcctaaaagggcagaagaaggacaaactggggcctgagatacccctggccatggaccgcttcccatatgtggctctgtccaaggtaagtgctgggctaccttagagtcctccaagcacagaaggggaatcctggctatggagtgtggtaggagggagggaccctaaacagctggggctccagtaaggagttagaggcagttggaatcccagaggacagagatcagggtctgggtctccgtgtctgccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctccgcccgccaggaggggtgccaggacatcgctacgcagctcatctccaacatggacattgacgtgcgacccccaggccaagggctggggctgggcagagagtagcagggagggggcactagctcagacccaggcaaccaaaagccttatctgggccagcagggtctggaggtggggttgtgggcgtagaaggtgcagcccaggctgggccattcccacagccttggggaggggagtcaggggctgtgcatgaggagggggcacggggccagccagggccccaaatccacctgccccatcctctgttcccaggtgatcctaggtggaggccgaaagtacatgtttcgcatgggaaccccagaccctgagtacccagatgactacagccaaggtgggaccaggctggacgggaagaatctggtgcaggaatggctggcgaagcgccaggtgatgggggctggcgggtgcagggggcacagcagggggagggcagaggtgtggggctcagggctgtgggctgaggcctggctctctccctccccacagggtgcccggtatgtgtggaaccgcactgagctcatgcaggcttccctggacccgtctgtgacccatctcatgggtaatgacccccttcctgccctggcatccctcagatggcctcagatggcaccttctgagcctgtgtgcacatccgccagcacccgcccacccccagcctgccagtcaccacaggaccccttgtcccacaggtctctttgagcctggagacatgaaatacgagatccaccgagactccacactggacccctccctgatggagatgacagaggctgccctgcgcctgctgagcaggaacccccgcggcttcttcctcttcgtggagggtgcgtggtggcccctggggagtgggggttgggggttggagcagggcaggctcagcatctcccccctctggccttcctgcaggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcggtaggcctggggagagtggcaggtgctgctgcagcaattaagtgggtgaaatctgagcctcagtctcctcctctgtcaaatgggagtaatgctggcaccagccctgtagggtctcctgaggactaagcccctgaccaggcaaaacgtggcggtgcctagcacgtgggagacactccacagctgtgttcagctcaaccacagggacccctctctctgcagggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagggtgccaaggatggggggctggcgggaaggggtcacctcctgtctgcctggaactgaatgaaccctcctaccggaactgaaccctccaaccagggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaa

SEQ ID NO: 197 - DNA, 1497 bp, Mus musculus
  Mouse SERPINF1
gtcactttaagaaaagagtagctgtaatctgaagcctgctggacgctggttgagaggcagctactcccctcactgcttcctggagcccctcagagtgcaggctgtgagagaagctgccgcaaccacagttccgggatgcaggccctggtgctactcctctggactggagccctgctcgggcacggcagcagccagaacgtccccagcagctctgagggctccccagtcccggacagcacgggcgagcccgtggaggaggaggaccccttcttcaaggtccctgtgaacaagctggcagcagctgtctccaacttcggctacgatctgtaccgcctgagatccagtgccagcccaacgggcaacgtcctgctgtctccactcagcgtggccacggccctctctgccctttctctgggagctgaacatcgaacagagtctgtcattcaccgggctctctactacgacctgatcaccaaccctgacatccacagcacctacaaggagctccttgcctctgttactgcccctgagaagaacctcaagagtgcttccagaattgtgtttgagaggaaacttcgagtcaaatccagctttgttgcccctctggagaagtcctatgggaccaggccccggatcctcacgggcaaccctcgagtagaccttcaggagattaacaactgggtgcaggcccagatgaaagggaagattgcccggtccacgagggaaatgcccagtgccctcagcatccttctccttggcgtggcttacttcaaggggcagtgggtaaccaagtttgactcgagaaagacgaccctccaggattttcatttggacgaggacaggaccgtgagagtccccatgatgtcagatcctaaggccatcttacgatacggcttggactctgatctcaactgcaagattgcccagctgcccttgacaggaagtatgagcatcatcttcttcctgcccctgaccgtgacccagaacttgaccatgatagaagagagcctcacctctgagttcattcatgacatcgaccgagaactgaagactatccaagctgtgctgactgtccccaagctgaagctgagcttcgaaggcgaacttaccaagtctctgcaggacatgaagctacagtcgttgtttgaatcacccgacttcagcaagattactggcaaacccgtgaagctcacccaagtggaacacagggctgctttcgagtggaatgaagagggggcaggaagcagccccagcccaggcctccagcccgtccgcctcaccttcccgctagactatcaccttaaccaacctttcctctttgttctgagggacacggacacgggggccctcctcttcataggcagaatcctggaccccagtagtacttaatgtctcagtgctctacagaacccccagagggaagctgattatacattccaggaaggcggccggtagcttcagtgtagcctctgcaataaaagagcttttccttaaaaa

SEQ ID NO: 198 - DNA, 1183 bp, Homo sapiens
  GPX1 Glutathione peroxidase 1
cagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaa

SEQ ID NO: 199 - DNA, 2509 bp, Homo sapiens
  Oxidoreductase
gaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtaaaaaaaaaaa

SEQ ID NO: 200 - DNA, 1206 bp, Homo sapiens
  Nucleoside triphosphate pyrophosphatase, transcript variant 1
tacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttttgaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 201 - DNA, 1876 bp, Mus musculus
  Murine MCP-1
gcagagagccagacgggaggaaggccagcccagcaccagcaccagccaactctcactgaagccagctctctcttcctccaccaccatgcaggtccctgtcatgcttctgggcctgctgttcacagttgccggctggagcatccacgtgttggctcagccaggtgagacccccccagctcccttcccagcatatcaccccatttttgaattgtcgtggattgtgatagcatagtctcacatggtcaggtacttttttttttttctttaaccaagataaggagcataaagaaggaaggacaaagagccaacccaattacaagattgcttctggaaagcaactagaattttaattgttagatctaaatttggaatcacaccttcatatagttcctgttccagttacttccctcagtatttgggaacctgggtgatcaaacagaggcttgggttggtgcctttttccagatagaggagaaaggggaagagatccaagatccgagctgtgtttcacccagccctgcttccagagatagcagcttagcggaggtggttgggatcagagatactcatgatttgattttttttttttttttttttttttttttttttttgcagcctacagtaatgtactcaggtaatcttctcaggtcatagtaatttgacttctaactcccccaaatgacagtccccagagtcacatagttttaatggcatccctctacccaagactgtgagcctactttaagctgcaaataactgagtctgttgtcaaagatcacatcccagatctgatgtattggcatttatatcccatcctgctgaaactgccttctccccgtggtccttctcttctctaaggtcagaagcatctttcctgtcctaatgtgcttctcttttactctccagatgcagttaacgccccactcacctgctgctactcattcaccagcaagatgatcccaatgagtaggctggagagctacaagaggatcaccagcagcaggtgtcccaaagaagctgtagtgtgagttacataccccggccctccctggtccaaaggtttttccttaagaacaagggatggtcctcatatacttatagtcagtcacacactcagatccaatggggaaaccaaggccaagaaggcaaaggcagttctcaacagcattgtctctatggctgctgttcaggccctttctactccacaagcttatcttagaaaacctgcaggagaagcaggtcactttgagtcccctttttctacctgccctcccccgctgagctctacacagcccctccatgtataccagactgaacttcatctaacagtgtcttttctcttcccacagttttgtcaccaagctcaagagagaggtctgtgctgaccccaagaaggaatgggtccagacatacattaaaaacctggatcggaaccaaatgagatcagaacctacaactttatttaaaactgcatctgccctaaggtcttcagcacctttgaatgtgaagttgacccgtaaatctgaagctaatgcatccactaccttttccacaaccacctcaagcacttctgtaggagtgaccagtgtgacagtgaactagtgtgactcggactgtgatgccttaattaatattaaacttatttaacttattgatgttatggtattccctttcatgaatactaaaatttcttaaatgcaaggtgtggatccatttttccctctctgtgaatccagattcaacactttcaatgtatgagagatgaattttgtaaagatgaatgggtaaactttgtgtttgagattccaaggtattgtttaaaatattattatggatattccttattattaaaagaaatatattatttttgtacacc

SEQ ID NO: 202 - DNA, 221618 bp, Shigella flexneri
  OspF
atgctgatgaaaatacctaaataatcagccagcactctatctttccaaatccacagcatagcaaagagagcaaaagagcctgtaaattcagaaattaaggaaacgcctcttggtgtacataatctatcttatgttaaatgaaatctaatttcttgattatatgctggatcgttcgtgggtggctttgcccctatatttccagacacctgttatcattggcccgctgccgcagatattcccgtggcgagcgataatccagcgcactatgcggatgccattcgttataatgctcgaatgcctctgcaaggttctttgctgccgttaacccgtcaggtttgggcatgatactgatgtagtcacactttattgttttcacgaagctctttgctattctgttactctccggactccgcaccgccgtgttcttcggttcaacaaagtcccaacatccgggtgaactggcgtgtttcattagctcggtagcatgaaccattatccgtcagtcacttcactggagacgccggaagctcgttgccgaagcggtgttccaccgctcccagcatgtcgccaacgggagagcatctacggtctgattgaactgtttattcaaattgtccaccgtctgtcagtacgctctgaacgtcggctggttaaaacactgctcgctgattttcagagggttcacggtaaaacagcacttttattccggattgcggaagcggctctgaataatccggatgggctggttaaagaggttgtgtaccatctgcatattgttgaaccagatcgcagcggtaagagaagttcatcatacttggcgcagttacgcgatgtttctgctagaggtgatgccgtaaagaacggcagaacattaccggaacaagatagcggtctacctgcactggtatcagacccggggcttccccggatgatctccacggtactttaggtactgtgtctatattatgtaggtaggatcaattaactttgtagttgaaattctttcattgaaataatgaataaaaaagacaaaccgcattaaacaatgccagaatataattgcatttttgttccgtttttttaaatcatagtatacaaagaagcttgcatactatatgaaaatataacaccctttactatgatgtttataaaacaatatatggagtcatgtaggtatgaatttagatggtgttagaccatactgtagaatagtcaataaaaagaatgaaagcatatcagatattgcatttgcacatataataaaaagggtaaaaaattcatcatgtactcacccaaaagcagcattggtttttttaggagagaaaggtttttgtgatagcaatgatgttctatctattatgggacaacaaataccaagagtatttaagaacaagatgttatatgattatgtttttaaaaatgaaaaaagtaaaaatgattttctaaaaatggctgaatcatggctaccacagagtgaaccaatagtaataaataatgatgatgacgcattgaatgctgctgcttatttttctgtaaaaaaagcgaaaataaaaacagtaaacgatactgattttaaagagtataataaggtttatattcttgggcacggtagtcctggttctcatcaattaggccttggttcggaacttattgatgtacaaacaatcatttcaagaatgaaagactgtggtattctaaatgtgaaagatatccgttttacttcatgcggctccgctgataaagtggctcctaaaaattttaacaatgcccctgctgaaagtctttcttgtatccttaactctctgcctttttttaaggaaaaagaatctttgctagagcagataaaaaaacaccttgaaaacgatgagtcattgagtgatggtctaaaaatatccggctatcatggatatggagttcactatggtcaagagctttttccctactcacattatcgttcaacttcaattcctgctgatccggagcatacagtaaaaagaagctctcagaaaaagacttttattattaataaagaactggattagtataaaatttttaacctatagttaattgtttgcatttaagatgaagttattttatctttagtagaaaagtgcttccctatgagggaaaatcacaaatcatcataatacagagacaaaacgatacgaaaaaatagataaaaaacatcattcttttaccacattattttccgtgaatatgaaaaataatgttattactttaatataagactattttttgtttttccatcactctgttcaaatttttccgcatgacttgtgttttttgtaatacagctcgttttttacagctgaccaaaatcatcaattaattatgctaaggaaataaattatgaaaaccaaaaactttcttcttttttgtattgctacaaatatgatttttatcccctcagcaaatgctctgaaggcagaaggttttctcactcaacaaacttcaccagacagtttgtcaatacttccgccgcctccggcagagaattcagtagtatttcaggctgacaaagctcattatgaattcggccgctcgctccgggatgctaatcgtgtacgtctcgctagcgaagatgcatactacgagaattttggtcttgcattttcagatgcttatggcatggatatttcaagggaaaataccccaatcttatatcagttgttaacacaagtactacaggatagccatgattacgccgtgcgtaacgccaaagaatattataaaagagttcgtccattcgttatttataaagacgcaacctgtacacctgataaagatgagaaaatggctatcactggctcttatccctctggtcatgcatcctttggttgggcagtagcactgatacttgcggagattaatcctcaacgtaaagcggaaatacttcgacgtggatatgagtttggagaaagtcgggtcatctgcggtgcgcattggcaaagcgatgtagaggctgggcgtttaatgggagcatcggttgttgcagtacttcataatacacctgaatttaccaaaagccttagcgaagccaaaaaagagtttgaagaattaaatactcctaccaatgaactgaccccataaagctggacagcctgtatcaggctatggagggcccatagacaaatctaccctatatgagcataggaggagtctatgggcacaccacgttttacccctgaatttaagggattactggaaaggctgggacatatccctccggcagaagcagaaaaagcttattatgctgccatcggaaacgatgatctggcaacctgagttcacagataaaacattctctaggaaactcggggcggttccgttcaccacatgcaatgtggtgttgcaggggaacggtctgcaccatcccctatgtcgatcaatataacagaaatgacaacttcagattcagggcacaacctaaatatattttaggtcacctctcaaatcgtttgcctgataccgctccattttttaataaaaaaatcaatcatttttgaatctttgcttttcattgcattgtcaagcatagtgtccccactatttgctttttgaaattttttgtttacatcaaccaatccattattgataaaatattctagcactttatagttggcaccatctttactaagtaagtattcaacatcatacagattacaatatctattgtttttcattttctccatctctgcgacatcttgttttgtaaaattaaatttagatagtaaataaagtgctatatcagcttttttattgcctaaagaataagcaagggcctgatgagccatttttttatcagtcactttattgttaatctcttcataattagatgctttaatcgcatcctccaaagatatgtctctgagttttatttttttgaagttatctgtacttagcattcttggtatatgatactcaagctgaaacacaaagtttataattctatccagactaacaggatcaatatttttgttataacaaaactctctgaatccttgatctttactctttcttataaaatcaataagatgcaacccaattccaagcctcatatctttagtgttaaatattggaacatcagttttcccctgattaccatgcacatacctgctaacttcatccacaacctctttaaagttatctaagaaaaatgattggtgctcatggtaaaaaacaggtggaatagcattatcaaagtgatcggttaatgtcatatatccatatggagagtcatgatcaatgatatacgcattggcgccaaaatctacagtatgatgtgttttatttagtgggagtttttcttgatgattggaaatttcgaccccaaaaaaaacaaaatcgtggttagagatttctttaatatcctcagagtatgtattcttatgtgtttgtatattttcagactgaattttatcaaaggatttaatattaagaataatatttgacagattagagttactttgatgtctgaagttaaaattagaattaataataatagaaagtaagtgacgttcgtctgaagaaagaggatgaactttttgtattatctcagagatatagtgcctggacaccttatcgagatgctcaagtgaccgaaatgatgaccgtgctccagatggcgcttcaagagaaagatttagtgatttgaaactggtcccttgagaaaacattttgctataactttgcgctgctatagacttccttaaaaagtttttcacagtattagcacagtgatctaaatgtttttcacttatgccagaagaagatgagtttgttacgcgtaatatattttttgtaatgcttttgttgctttattcggattcgtttttccatcaacaagatcaatattattctgaacattaatatgatttactgcttcaggtattttcataaaatattccccattatgtgcgtttttatctatggttatttagaatatattatctaacttaatatttccttgtgtgtattataacgaaatgaacatattttaatatgttgtacaatttttactctgaaatcccctgaaattaatcacacctcctttactgaaaggaattattgcaacggtattatttgtttttgtatatatatcttgcgccttgttatgtagttaatcctcagaatatgatagataaaatagagacacagagcagagcgtgttctaacatcatgataacataaaataattagtaacaataaatgaaagaatcatgggagctcaacaaaaagagagctaaatagctgtgtggaatagtagatcactttggcggtataatggcagatggtctgcatactttccggtaacaacatgggccagaagccccgctccggcataactgcgtgcaatgggttttgaaggcaccggtgcctgcacgatatggtcgcaccggcgacaggccagtttagggcgttgtttttcgataaccttaaaggcgctgctgataagctccagctgctctgacacatcacatcccagtggactgagttcaccaccacaggccggacagcattcctcttccggccggatgacccggggggcacggggaagtgaggctggtaacggtttacgggctgaagactggcgcagggaagatggcagtaccgggtcatattgctcacccagtgtttccgccatttcctcctgaagtgcgctgattcgctcctgtgcttcctgtatccaccgttcggtttttgcgcgaagtttttctgagcttttaccgaactgcatacgctgcagtttcgcgaccagcgccttcagtcggttgatttcggaaggcctggacaactgaatctgcgacccagacctgattaggtgctgtgggcgtaaagttctgattcagcagattcggcgtaaccggcagattgtggtcagagtttgtggtcgccctgaacttgcgtttctgcttacagtgcagcctcagctccttacgaagacctgccagtctgtcacgaccgacgataattccgttatctgccagctccgtctggagccgccgggttccatatgtttcgcgagtgcggatatacaccaggtgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcagactctcatttttcagcgttccccagaagctttccatcggagcgttgtcgtaacagttacctttacgcgacattgatgttttcagaccagactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgtaggagcgaacgtctggttcagcagatttggcgcaactggcagattgtggttcgggttcgtagttgctctgaacttgcgtttctgcttacagcgtagcctcagctccttacgaagacgtgccagtcggtcacgaccaacgatgatgccattctctgccagctccgtctggagccgccgggttccatatgtttcgcgagtgcggatatgtgccaccttaatctccagttttagccgctcatcactttgttttctgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgttttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactatttagagtaacgttgggtttttctgctcattattagctccttctgatgccattctatttcaggaaggagtgtccgttaaactcaggctacctcaggttgccaattgaggtggttgcctgaaagttggcagttacccggtcactacaccttgttggagtgaacatatcaaaaacaggtaattacacaatttaaattacagtctcataaaaaatgattaaatctatttattatttcaataaacgtttttttcatcttctttgaaaattgttctgctatagtatccggttccagattgttctcttttattattctacaatactctaatattgtttctttgtctctatttactacagatacaaatacaccaggaataccatctttattagttgcggacagcatttcgaccaatcgtcttgtggtaaaactatagttttttagaatattacaaaaggcacgtattgtttcggtatggccattataaaatgccataaaaagtcctgatgtaccgttgggattttttatccataataattcatctatatattcctggtgaggggggagtatttttagtatatctccatacgccataatggcctttgtgtgcccattttgaagtgccataaacaacccatgctttactttcaataattctttaatttgttcactactaagcattttcttattaagcagacttccgaacatacgaatactatctgcatgtccattctgcaatgcaaaaaataacccaggtaaatcatggctgtctttcgcagctaatagatataatctcttatcggaagttaacggggttttaaagactatttccccataggcttttattgtgtctacatgtccgttcataaaagacatgcataaacccggcacattgtttgcccctaccgcagcaagcaatgtaagtattgtttcttgactaagattgcacatatttaatatcttaccatatacttgaataatgtctgaatatccgttttgaagtgctatataaaatgcaggagtaccatcagagcttctcgtggccagaaggttcaccagtttagattgagaaatttcaccatttttgtatttttccatcagtataaataatacttctgtcagattctttgttatcgcatgatatataactctggaattgatcaattcatctggtaaaagtttcactgtgtttgttagaggggaattatgcctatcttcaaatattacctgcccgggttgctccagaccataaattttccaataaaaatcatcaaaaaaatccttagcggataattgactcagttcgaaatggctatcacaagtaaatacagtacgtttatgagtaacagttcgattaggatcgaaaaactgaacaacccatttttcactttcttgtacgcgctttattttcaaccctaacgccatttggtggtttaatgtgcatgctgataatgttctgacaaagtctccattttttttcatgttataaaaaaaattagtaataactgttccccactttttattttccacaaaataaatataagctggtgattttgaaaaatcttccgttttttccaaacatacattttttgcaatagcatcaggggtgctaagaagctgatagtttaccttcccatttgtttccataaaattcatttcccaataggaagctaggtgacggcaaactatttgtcttccatatatatcttttgccactccatttatatttacctccacatttctcttttctgaaaaataaggtgctgttttattcttaaactgaattagttcactggagtttgagaccctcataatagaacttgttattgttctattatctctgttaacagacatatctgttgataacgaattttttgttgaaaatatactagatgaaaatgttttatttaacggcatagaagacaaccatagagatgttataatactattagattgcagttactaatagtaaaagcctccttacaaggaggtagcttattcagaatgctcctataagatagcgagctcgtcaacgatacagatgatctgattatattgtgcaaaaggagaacaggaaaataggcactggaaaagatgaaggcctgatgggagcattaactaatgcaaaatccgacaggttaatatcccgaaaagcaatcaaacgactcaaacaggagatgcacgctgaaatggtggacaactgttcggatttcagatgagtagctcagcagtttatgagccgaatgctctgtcacgggcaggaatcaggctgcatacgcagtgccaaatctaatcgtagttattctaaccagttttcaagctacaaggtggtgtagctggcatcttctctactctatcatcaaacgataaaatggttcctctcgtaacatttgctcttgcctttcacttccatctcgatcgcttcgtagttcattacgatagctgacatatttccagtcttcaggtctaacatctgacgccggatactccccgggagcgattttgcttcttaatagattagactcgagacacattataaattgtcgtattttatgaagtaataaagcactatattgcgagcattcctgatctgattttacatatagcgtaaactgagctcctatccccacacgagattgctgagaaactcgattcatatcagttatcttccatttatctataggactgtcctctgaaaataataaaccagacaaaatttggaatgccagaggaacttgctccctagctatactaatatgaaacttgtccccaacaaaatcccccttactctgaggattttcacgacatgcatgaataaacacatctccactatggttcacaatctggaatccttggtacatgacagaaaaagattgacatatatcagagtaagttggcacgttcgatgctactttgaaatagtacgctgggtattgccgtatttggttgtacaatatattgaagttatttttcaatctttcattcgcagaaagcatctgcggtatttcagacctcacaacattcaaagaatctaaatttagttttagacagggcttttttatgggcatagaaaacgtcctctataaaatagatatattatcttatattgattgtttatcatcttttataaaacgatacattatatgtaatgtatgtaagcgtaagggtcctctccgaacatggtgggaaggcttagaacgccatattcagtttcccatagtggaacatcactcccagcttaaagcgctcccggttgcggtagcccttggcttttattctcagcagcctgatcttgctgttcagtgcttccgcatttccgtttgatacgccatggcgcatggcgttcaggataccgtacaaccttttccctatcgttttagccacattcttcatcatggggacgtcactgttggccgcagccatctctgccagtcgttgcgtctttcctcgctccatggtctgctccagatatcctttgccagttctttcagcgcccagcacaggctcgtcagcttcatctgcgcacgcagccatatcagcttttcctgcctggattcggtcatccatttatcgctgtgctgccacaggaagcgagttccctttgcctgacgacgactttcaacaggaagatgcggatgttcattctggcgggttttatccaccacctcacccggttgtttcgccacatgaaagcgatcgaaggctattttctcaaccgcattgggtaagtggatgcgcgctgctcttagtttgctgagccagtttagcattgccttctacatgaccgatgcctgagccggtataccgaactttattgtcctcaaccagtcatgttataagcaagaaatgcactcagcggatagagcgacataatctgaacctgcggacacatcttaagcggcttacccgcaaaaccatatgcttctcaaagtctgatgatatgcactacaagatcatcggctggtatctgacaatcaaccaccaccactaaatctgcgtcacgacctgcaactgagtctggttgaacaggctgaggccctgctgaagcaacgcgaacctctcgactcttgttggattttaccaaatagtttttctaaaattaaacacatttatataagttctttgctgaacaaaacgcagcccgccatcctttttcattcataaattcagcaatggcagataaaactttttcatcaagcatataaaaaataatgccagtagactcaatatgcctcatacaaataaggccgcacatatccgtaatatatttgtcaatgctgctaccatttgcatggtaatatgtcatgctattatctgatgattttacatatgcagtatgacatatttttccttcacgattaacaaaactgacaaaaccactttcaccaggagtaatatataaagatgaatttaacgtgcgctcactaatattcattaattgttgaaattcaatggaatagttttcagttaatgtatctattatcttggctttgtctttctttgttatctcattgtctttttcggcaagaaaaattgccactttatgacatgcattcagctcgttaattttacctgataaaactgctttttttaccacatcgttgaactcatcgatagtgtgttttttattatatatatcatgaaaaatatagcctaaagacttaaacgagactttcattttatattctccttaaatattaacaggatatatatatcacattttcctctatattttcagaaaccagctatcattttccccattactggtacgtcgcttcagatatttccgcagcaagcgataaccctgcgcactatgaggatgccattcattataatgtttgaacaccttcgcgagactactttactgctgttaacacgtcaggttcgaacataacactgatttaatcatatttcatcgttttgacgaagttttctgccattccattttgcaccgccgtgtgtttgggggcaaggccgaccatctgtgtttcattcgccagatataagtgatgagatggcattctccctccttcacggcagaagcattttgaccgtttaggggatgcggacgattttcatgcctgctaagatactttcgttactgatgctgtccgttttccaccatttcatcatcactgattggcgttgtgtttttggtcagcactccagctttacgtttctcttttaaccggtaactctctcctttgatattcagcgtgtagcagccgatctaggatcgctgttgccagcacgtgatctccgaacatttctccccagtctgcgacccctttgtttgacgtcagtatgatgctcgctttttcatatcgacagttcatcgataggaatttaaatccccaaaagattaaaaaagcaccgaagaatgcgcgtttattcaacacaacctgatcatcaagtaatcggtatagacacttaatattgcttacattgattgattcaatgtatctctgatggttttttgctccgttcccctcaacatggacgcaacttcccctctgcgactctcagccgcaccaccgtattcgagccagcggctcatgcatcataacctgctctgccagacggtaacccctcttcagccccgtaaaccgcatctgacctccgcgcagctcgcacttcagcgggtcaaccttcagtcactgctgatacatccctctccttgtgatttgcctcgccgtttttctcactgtctccgttatggcgtacaccacatcttccagtaatcgccgcttcaccggactcaggaccccgtatcaccatccggaaccccttatccgccacatgccaagagaacctttccataaactcgtcgccactcatcacaaggttttcttctcgttttgtccggtggctgttgtaacgcaggccaatttcatcctgaccggcataatgttccaggcggctcatctgcaccggctgcttctccagccagttaagccatcggtttccctgctgaaaaatatcggcaaaacggggaagcatcagaaaggcggaataacgccatccggccagtgaaccgtaccgcattcagggcaatacatgccgtcggcgttgataccggcaggaattgtcgcaaattcccgctccatgcagcgggcaatttccggatacccttcgtcatcaacacgtacaaaccagaagaccagttttttgtttccggcatccacaaagaacggaatattcaggtctgcgcaacactcaacggcatcgtcaaaattatcaaagcgcagaacctcagcttcttcgtaaccggctcatttaaaccgtctggtctgtttcctccggctccacaaaaataatgtccatcattttgaagtggacactatcgtatggaataccggacctggatcactgaagctttacgccttcatttcgaagaacatttaccacgggttgtagccggacgtcgcctgggcgtaccaaaatcaactgtctgtggtatgttcgtgcgcttccgcaacgctggcctttcatggcctctgcccgcaggtatgtcggagcaggaacttgatgcccttctttacggaagtgcctccacagtacctgtcgtacttactgaaagcaccgttatgcccaaactcccggtggtaaaaaaacgtccccggcggccttaatgccagtcagttaagcaactgactggctctttttcggggctgtggggtatttccagggcctctcctttaccactctcgggaaggcccttccccttctcgtcggtaatttcacaagttgtcccatacttgcaagatcgcgcatcagctccggtatacgtcccggtgaagcgccctgcaatgtcatcagcattctcatcaccattccgcatgattctgagaaactcagttgattcgggcagtaacctttcagatgttccgccattttaatcatctgatatctcaccagattataagccagtaagacaccccacagctcttgcttcacaagctccggctttttacttctcagcgtcagcctgctcagttgcatcgtctgttttatctccctgtatcccagttcgatttcccagcgatgactgtacagatccgccatttctcctccggggaagcgcatggcgtccgtcatcgacgtcagcagatggcagacttttcctttgcgcgtcacggtcagcaggcgggctgtcacttcatttcccagtcccggccacttttttcgtgcctgcgggctggttttcagcttcaccagatgatcgcctttacccagttttctgagctcttcatattgcgctccctttctgagaggtatcatccagtggcggtgttctcccgccaggctccagccatttaacagtcccagtgagtaataacctttatccattaacgtcagagtgttatcgccggtttgtcctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggatcccagatcaagagcctgtccaatgtgcataaaagaatccggcaactgagtgagcgtttccggattcttacacagccactggatcggtcaactgatccttaactgatcggcattacaccggcggcctaattttccttatgaatttaaaatcgctttagtggagcagtcactgcagcccggagcctgtgtggcgcagatcgcccgtgaaaacggaatcaacgataacctgctcttcaactggcgccatcaataccggaaaggtggcctgctgccttccggaaaaaatatgcctgcactgcttcccgtgacgttaacgccggagccggataataaaatcccggctccggcacaggaaccagagcagataaatacaccgtccgacagtctgtgctgtgagctggttctgccggccggaactctcaggcttaaaggtaaactgacgccggcgttattacagatacttatccgcgaaataaaagggagcagccactgatgatatctttccctgcaggttcgcgtatctggctggttgcaggtatcaccgatatgcgaaatggctttaacggcctggtctcaaaagttcagaacgtcctgaaggatgacccgttctccgggcatctgttcatcttccgcggacgccggggtgaccagataaaagtgttgtgggctgacagtgacggactgtgcctctttaccagacgcctggagcggggccgcttcgtctggccggtcacccgtgacggcaaggtgcaccttactccggcccagttatccatgcttcttgagggcatcgactggaaacacccgaaacgaacggaacgcgctggcatccgcatataacccgttgtaaagtgaggatatggacacctcacttgctcatgagaatgcccgcctgcgggcactgttgcagacgcaacaggacaccatccgccagatggcgaaatacaaccgcctgctctcacagcgggtggcggcttatgcttccgaaatcaaccggctgaaggcgctggttgcgaaactgcagcgcatgcagttcggtaaaagctcagaaaaacttcgcgcaaaaaccgaacggcagatactggaagcacaggagcgaatcagcgcacttcaggaagaaatggcggaaacgctgggtgagcaatatgacccggtactgccatctcccctgcgccagtcttcagcccgtaaaccgttacctgcctcacttccccgtgaaacccgggtcatccgtccggaagaggaatgctgcccggcctgtggtggcgaactcagttctctgggatgtgatgtgtcagagcagctggagcttatcagcagcgcctttaaggttatcgaaacacaacgtccgaaactggcctgttgccggtgtgaccatatcgtgcaggcaccggtgccttcaaaacccattgcacgcagttatgccggagcggggcttctggcccatgttgttgctggaaaatatgcagactatctgccgttataccgccagtcagaaatataccgtcgtcagggcgtggagctgagccgtgccacactggggcgctggacaggtgctgttgctgaactgctggaaccgctgtatgacatcctgcgccagtatgtgctgatgcccggtaaagtccatgccgatgatatccccgttccggtccaggagccgggcagcggtaaaacaaggactgcccggctgtgggtctacgttcgtgatgaccgtaacgccggttcggaaatgcctccggcggtctggttcgcgtactcaccggaccggaaaggtatccatccacagaatcatctggccggttacagcggagtgcttcaggccgatgcttacggtggttaccgggcgttgtacgaatccggcagaataacggaagccgcatgtatggctcatgtccggagaaaaatccacgatgtgcatgcaagagtgccaaccgacatcaccacggaagccctgcagcgtatcggtgaactgtatgccatcgaggcagaagtccggggatgttcagcagaacagcgtctggcggcaagaaaagccagagccgcgccactgatgcagtcactgtatgactggatacagcaacagatgaaaattcattcgctgaaaatggaatgtctccacggagaacactattatccatcgggaaatagtgcgggcaacagtgtttagttatatcgagtgcgattacaatcgctggcgacggcaccgttggtgtggtggtctcagtccggaacaatttgaaaaccagagcctcacttacgactgtgtccatattatgtgggtaggatcaataaagacgttttatatgtgtctgcttgcagccagaaaatttataccctgcaggtatcataaacatgcttgacaacttaattagggccccctcttccttttatggtgtaattgtttgattgaatacttccggggatttcagtatgaaatgaagtatatttaatatactttacaaaaagtttgtattagtggaataagaacaatagtttatccaaactgccaagcccctttattataagtaagatctggcactggaatattctcaaaaggactaacatcatcaccacgaccttcaaccaaccataaaaaacaatactattttaggtgatgtattaaattagtagaatatttattcttctataaaagcactaccccaagaggttaatcaggtcatccatgattatttatcatatactaactatgtgggatttcaacgtgaaaacttattttcactataatcttcaggattcgaagatcataggagcctgtacataagtttgtataattctctgatgttgaactatttaatttgatatcaaatgaaggtgaatttatgaatgaaaaacagttgacatctaataagttgcgggctttagctaatgaactagccaaaagtctcaaaaatcctgaagatctcagtcagtttgattggatgctgaaaatgaaaccgtactcaatgctaatatgactcatcatcttgggtgcgagaaaaatcagcttagatctggcagcaattcccgcaatggttgcttaacgaagattatcactactggagatgaacctctggaaatccgtactctgcgtgatcgtaatggcactttcgaaccgcaacagctgaagaaaaaccagccctagattactaaatttgtcgggcgatggattaactggttcaggctgtctggtgctgaaggcctgaagtcactgctgtcagtgatgtggccggctcttcatgagacaataacccgtaatcatcagtgccgttcaatatggccactgttgaaaaaagttcgtcactttatggagacggttagcccacttcccggagaaaaacatagtctggacaaagtgtagcggtattaggctcacatatttagatgtagataagccggagctggcagttaaatctaggcagcatcacagaaatggacaacgccccttaaggactggcgtatggcaatgagctgctttattatcaagtttggtgatcgccttgacggtcacttctgagtgaaggcgcttgcacagaatggtaaacggactcgattattgaatcttagggataagatatatctacgatatgtcaatatacgaaatcgaaagaatttattggtgaatatagccattcaatgtggcaatggtttttttagattagcaatagactaatatctattacattacaaaaataggttattgtttttttttagcaaaaaggatgaacaaaaatgtcaataaataactatggattacatccagcaaacaacaaaaatatgcacttaataataggcagcaatactgctaatgaaaataaaggaatgaaaaataatatcattaacgtgacaaataccgctatatcccacgccatcaatgaagaaaaatcaggggggggatatagtggtgtttctttcagaaaattggccaaaatacagaacatatccattccgacaaagaataataaggagtataaccgccataatttgttttcattgatttggcatggaaatgccgatgcagcgcgtaaatacggtgaatcgctgttggcagccgaaatacccaaagaggaaaaactagaagttcttgcagcacgaaataatgctggggaatctgctttgttcatagctcttcaagaaggtcattccgctgcgattcaagcttatggagattttattaaaacttttgatttatcaccaaaagaaacgattaaactattggatgtaagagataatgaggggttaccaggattatttctggccgcagggaaagggaatatcgaggctatgatggcatatataaatatatgccatcatagtgggataaaacttacagaaatagcagacagacttaacaataatgaacaagacatgtttaatattatttctgacaaaatacaagagttgttttaagtgtgctaaatagctgcaaagaattgcacttagaaggatctctccccgaattgtgtgatctgcttaatttctaaaaagaaacaaacagttaactagactgagcgatactacccatagaaccagtttcccatgacgaacgacactggacgcaaaaacaatcataaaaaacacaataaatgtaatgaacacatcccaccctattaagtaaagtgcactgtgatagaggaagggaaatacaggaaggtgtggagccttgcagatttctggcatcatagtgcccaatacggaatgcataaagccctctcagactggagactccacaaatgaaatatacagtgtttaattatatcaagtgcgattacaatcgctgacgacggcacagttggtgtggaggtctcagtcctgaacaatttgaaaaccagaacctcacttaagcctgtgttcatattacgtgggtaggatcatacttttatagaagctgtcagcggctacgtcccagccaaatcacttcatgctccagcgccagagaggcaaggttgggtttgctcagctgccggttgattttgttgcgattgaaccggacagcgtccagggcgtcggcaaaagagcgaatctcaccaatcgttgtttcattatccgcattaacgatagcttcaagaaacgccaaggttttatcgaatttatcagcaacagtggctccgggcataccgtgaccgtttatacaaaacggcgttttcagcgtggagttttcatgaatagcctcaacacgaatgtcgtgaagccagtgatgtatcggctacgatcctcagctgatgccagaccataggactgacactacgaacagcaattttaatgacgtaaatcttcataactacaactaacagggcatcattatgaatgatgccggttattttaccgctgttggtcccttcatttagggactgccccaagttttttcatactctctttctcagagagtttagtctctgggattccagacggtccatcattgagccaagggagtaaagaactcaaagcatttacagaattgtttgaatcagctaaaataatgacaatgttactattttacatgacaaggtgattataatgcttggaacatcttttaataattttggaatcagtttatctcacaaaagatatttttcaggaaaggtggatgagattatccgctgtacaatggggaaaaggatagtaaaaatatcatcaaccaaaataaatactagtattttgagctctgtttcagaacaaatcggtgaaaatattacagattggaaaaatgatgaaaaaaaagtctacgtatcccgggtggtaaaccaatgtattgataagttttgtgcagaacacagccgaaaaatcggcgataatctccgtaaacagatatttaaacaggttgagaaagattatcgcatttctctagacatcaatgctgcacaaagttccataaatcatcttgtatcaggaagcagttatttcaaaaagaaaatggacgaactttgtgaagggatgaatagaagcgttaaaaatgatacaacaagcaatgttgcaaatcttatttccgatcagttttttgagaaaaatgtgcaatatattgatctaaagaaattacgtgggaatatgagtgactatattacaaatttagaatcgcctttctgatgacagaacatcccgagtaaagaaactaagaaaagtaaatacccaggaattgcctgagcggtgctatatttctcctcgcaagtaagtcctaatatattgaattgttgtatagccagtttttgtattttcctagctcatggatgtgggatccctctcccctttctctgctcaaaggtaagcggctcgtcagaatcatattgatatttactgagaagtcagatcaactttccaaggcaacagatcgcgtacccggtttgccggtcagtcctggatatgttcaataacgtaacgcagccatttttctggctccacattgttcagacggcatgtgccgatcagcgagaacaacaccgctgcatgttcgtcaccgctgtcggaacctgcgagtcgagtcagccggagagagtttcactctccggctgcttacggaaccgtacgtgacactctcgcgtcatacggctcttgatcactcattcgatgcacgtagtaaataccagtgagcaaattgatcttacccagcaatacggtcagttaccgcgcacatggcctgcctgtgtcagaaaatctgctggagcaggatttttacgccagtggtccgaaccagaagtgggcgggagacatcacgtacttacgtacagatgaaggctggctgtatctggctgtggtcattgacctgtggtcacgtgccgttattggctggtccatgtcaccacgcctgacggcgcaactggcctgcgatgccctgcagatggcgctgtggcggcgtaagagaccccggaacgttatcgttcactcggaccgaggaagtcagtactgttcagcagattatcaggcgctgctgaagtggcataatctgcgtggcagtatgagcgcaaagggctgctgctacgataatgcctgcgtggaaagcttctttcattcgctgaaagtggaatgtctccacggagaacactttatcagccgggaaataatgagggcaacagtgtttaattatatcgaatgtgattacaatcgctggcgacggcacagttggtgtggcggcctcagtccggaacaatttgaaaaccagaacctcgcttaggcctgtgtccatattacgtgggtaggatcacttacgccctgtggttgaaacgtgagcatattgttttcagatgctgttgtcttgcttcagagtgatctgtcctccggatttacgcaaagttatccacaggcactgtgcatttaaaaaacttatcttttcttcttgattttaaaaactcagatcgtcatatcattatgataaacataataaaaaactctaaacatgagaaggtttttaacgtaaggtgagaggatttttaagtgtatccatagattaaaaatgacaatgcctccaattagttgaattaggggttataatacccgcttttaggttctttcatggtcacagttaactttcattgcccccgttgccagtccgttcaggtttaccgtcacgggcagaacccaaaaggacatgatcgattccgttgccgtgactgtcaccgggtgtttcagctcacttactgttacgaggcccgtaaaccgggagttaaaaaccaaatcactgaaatggctttcaacggtgccggagttcgcgatactggccgtacgctgaaaatcggcatcaataccgtcatacggacattaaaaagctcccgccccggcggataacatctgcgccagtcgctcacgctgatgttgcccttatctgtgaacttgatgggcagtggagcttcgttggcagcaaggcgcaacaacactgtcacgaacggtgcaatagtgatccacacccaacgcctgaaatcagatccagggggtaatctgctctcctgattcaggagagcttatggtcacttttgagacagttatggaaattaaaatcctgcacaagcagggaatgagtagccgggcgattgccagagaactggggctctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttcccggatacagccgaatgttgtacatcgaattcactgacaatatgcgttatgacacgctggagacctgccatcgtaatgcgttccgcttctttggtggtgtgtcgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcaggctgagggatccccacaaaattactgctaataaaccagcaccatatttcggtaggttctggacagatggtttagaactgtgctcagtactgttcgtcttaaaataagtggcgagtgtcgaagaacattcttcgctaacgtcagatatgagataacccgccgggatttaatgctgttagcctgatatttcaggtgtaaccctttattttcagcgtgataaccgagtaaccacattacgatagtgctcaacgttgccagcagactcagaaccagaattcttcctgttgaacgacttttgctggcccgaagaccaaatccgaagcgcccgttcttttcatcacgaaagttttgctctatctgcattcgccgactgtataacttgatgatttctcgcgctctgaagtcatttgtactgctgaagatcaaccaggcttcttttgctgatttgctctgttctttgtctgttttgtttaaaccactctgacctttcgaacgtttcttttttcgcccttttgccgatttcttataggtgtaaaaatgcccccggatgctttttttcctttctttaaccagccttccagcccccatatattccggtgttttacattcagggctatccgacacttttaaccatctttcaggcgcgttatcgaggcaatactgaacgttatttctgatccgaccaataaaatcccagcccagagaagtaatatggtgaaaccatgcgctctgaaatccagcatccgtgacaataataaccctggcatcggggggcagggattgagcaagggaatcaaggaaatcatgttgtatcaatggattattttgtttttcagaaggaacaaccttactcaataacggaatggaacgcccgtcacacagaaggctggcacgaagaacatgatgctcctgggagggatagccactccagtctacggctattacacataaagataactgccgtgtcagcattgaagtgatattcctgaaaatcattggaatatcgcgatggagcgcctcattacccatgaggcgatcaatacgtttgatcttattcttaacttgtgcattacccggcaaaaaacgtccgatactggtctgcgtcagagatgctccgttgattaacgccattgtggcatccatcagggcattttgtcggtactgatgaaatggtgctaaggcatcccggaagaaattctgacatactttatgaacaggcatagcagtgatctcattgaattgttggcacaaatcagtagatcacataatgctatgtttgtctcgttttctggggattcctcagcccttcagggcacagactaaaggtaaggtggaacggatggtgcagtacacccgtaacagtttttacatcccactaatgactcgcctgcgcccgatggggagcactgtcgatgttgaaacagccaaccgccacggtctgcgctggctgcacgatgtcgctaaccaacgaaagcatgaaacaatccaggcccgtccctgtgatcgctggctcgaagagcagcagtccatgctggcactgcctccggagaaaaaagagtatgacgtgcatcctggtgaaaatctggtgagcttcgacaaccccccccagcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgtaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaaactgttcttccaggtcatcgctaaacgttacgaaaagagcgcaatgatcctgacatccaatctaccgttcgggcagtgggatcaaacgttcgccggtgatgcagcactgacctcagcgatgctgggccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacacaacactggctctggtatgcgtacaacactaaaactggcggtgtgttggcttacactttcgggccacggaatgatgagacctgtcgggaactgttagccctgttgactccgttctgtatcggcatggtgaccagcgatgactggggcagctacgccagagaagtgccgaaggagaaacacctgaccggcaaaatcttcacgcaacgtattgcacgtaacaaccggaccctccgcacccgcatcaagcggctggcacgtaaaacaatctgcttctcgcgttccgtggaaatccacgaaaaagtcatcggctccttcattgaaaagcacatgttctactgattggaagcactacccccgcctgttgcgacagtcacgtcatcgccgtccgttaccggaacatgtttcccgcgaaatacaccatctggagcctgaagaaagctgttgtccggagtgtggtggtgaactggattattcgggggaaatcagcgtctttctcccggaaaggcatactatcttacagtaatattcattccgatgattaataaatcagcaatgcgcgcatttttaatataagcatgtacaatatgtacttgcatgcattaccctgctaatgcagttttttttgtaataagttaaaatcctacatagcacggagggggaatgactagttttgagcagttaagtaaggttgcgcagcgtgcagataaaatgttgctcgccctaacaaaacagattcaggagcaaaagcaggagtttcaggctgatgttttttatcaagtctattcaaagtctgctgtagctaagcttccaaaattaacgcgcgcaagcgtggatggtgcagtcggtgagatggaggctcagggctatcagtttgaaaaacgcccagcaggaaccgcgacaaaatatgcattaaccatccagaacattatcgatatctatgcacatcgtggcattcctaaatatcgcgatcgttatagtgaggcatattccatattcatcggtagtctaaaaggcggtgtgtctaaaaccgtgagtagtgtttccgtagctcacgccctgcgtgctcatcctcacctgctgtcagaagatttacgtattctgctccttgatttagatccccagtcatcagccactatgtttctgaactacttgcatgcggtggggctggttgatacaaccgcaccgcaggctatgttgcagaacgtgagtcgtgaggaattactggaagattttatcgttccgtcagttatccctggcgtttatgttatgccggcttctattgacgacgcctttattgcatcaaactgggatactctgtgcgaggagcatctattaggacaaaacaaacacgcgatattgcgtgagaatattattgataagctgaagcatgatttcgacttcatccttattgatacaggcccgcatctggacgcatttttgaaaaatgccattgctgccgcagatatcatgtttacaccggtgccgccagcacaagttgatttccattccacgcttaaatatttggctcgtttacctgaacttgtacagattattgaacaggatggatgttcatgccgtttgcaggcaaatattggcttcatgtcgaaactggcgaataagtcagatcataaatactgccatagcctgacaaaagagattttcggtggtgacatgcttgatgtttcaatgccacgtcttgatggttttgagagaagcggcgagtcgtttgataccgtgatatctgcgaatcctgttacttatgttggcagtggtgaagctttgaaaaatgcacgtatggcagcagaagatttcgctaaagcagtttttgatcgtattgaatttataagggccaactactgatggaaaacagaaagcaccgaccgactattggccgtacgctgaatacaaatatcctgaataatactgaagaaatatcggctccagttcatgtatttaccctcaatactggccgaaaggcaaaatttactgagatcaaggttgatcatgacaaagtggatactcaaacttttgtggtcgaagaggtgaatggccgcgaacagacagccctgacgccggactcactaaaagacatcaccagaactatacgtttacaacaattctatccatgtattgggattcggactggcgatcttattgagattttggatggttcccgtcgtcgggcagcagctttgctatgcaaggttggattacgtgtacttgtaacggatgatgagcttactgtttctgaagctcagcatctggcgaaagatttgcagacgtcacttgaacataatattcgtgaaattgggttgcgtttagtacgtctcaaagaggccggtatgaaccagaagcaaattgcggaaagagagggattgtcggcagctaaggtgactcgtgccctccaagcagcgtccgtacctaaagattttgtgtctctttttcctgttcagtctgagctgacatacgccgattacaggcaactggctgaattaagtgaacgactgaggctgggtgatatatctattgatgaagttgtgaagaatatctcgccgagtattgagcttattactgctgatgacaatctttctgaagacgaggttaaaaacagtattatgcggcttataaccaaggaaatgtcttcattgcttgattcaggagtaaaggataaagcggttgtaactttgttatggaaatttgatagtaaagataaatttgctcgaaaacgagtaaagggacgtacgttctcatatgaattcggcagattaccgttggaagttcaggataagttagatcgtatgattgctcttgtactaaaagataatctgaattcgctgtgaaaattcaagtttttcgccagcaactcgccagtttttaattggctgttttaaaagaaattttgcttttattagcgttttttttgaacagtatttcacggtgaaatcgcctgtttcaccgtatcttctttgcttgaaaaagatagtttctcttagccgtttaacagtaaccgatgagatagtcttccccctctttcacggcagccttcaattgcgccatgatggataaactttaacaacaaaagtaagcgggataccatgtctgaacagaaaatcaccggcattgatctggctaaaacgaacttttatcttttcagtatcaatgctcatggcaaacccgcaggaaagaccaaactttctcgcaatcaactgcttaactggctggtgcaacagcctaaaatgactgttgcgatggaggctggcggggcatctcattactgggcccgggaaatcaggaaactcgaccatgatgtaatattgcttccggcacaacatgttaaagcttatcagcggtgccagaaaaatgattataacgacgcacaggcaatagctgaggcctgccaacatggaactatacgacccgtaccaataaaaactctggagcaacaggacgtccagacttttttgaatatgcgtcggttggtttcaatggaaaggacacaactgataaatcacattcgtggacttcttgctgaatacggcattgtgttcagtaaaggcgcagcagaattacgccaaaagtaagcggctcgtcagaaccgtattgatatttactgagagctcagatcaactttccagggcaacagatcacgtacccggtttgccggccagtcctggatatgctcaatgacgtaacgcagccatttttctggttccacattgttcagacggcatgtgccgatcagcgagtacaacaccgccgcatgttcgtcatcgctgtcggaacccgcgagtcgagtcagccggagagaatttcactccccggctgctcacggaaccgtacgtgacactctcgcgtcatacggctcttgatcactcatttgatgcacgtagtaaataccagtgaacaaatagcttcggatactccttccttaccagcgtcagctttcgctgagccttccggttcgaaagtctgtatttagactgcatccacttgagcagacgtgactgcattgcactccacagtcgatagttgaaatttctggaccagaactttccgtagtactcgatccagcctctcactatcgcattgtagcgcctcgcaaaatccagcaaactctcagctgttgagcgatgtatacgccacttcttgattgtttctgttattttgcgcattgctgcatttgacgcacccggcatgcattttcggtaccgttcgcctttgaaattcttcagcgtacgcactttgaagtcatatccgagaaaggtgaaactcgttgcgacgtttctccttttaaacgtgtcaatgtaggcgatattcgttttccctgcattcaggaccagcccgacttccgagaagcgctccgataacctgttctttagccttgttgcatcactcattcgtgaacaatgtactacaatatcgtcagcgtacctctcaaacggtaccccccgatattctctttccatccacaaatcaaatgcatagtgaaggaacaagttagcaagtagcggactaatgaccccgccctgcggagtgcctcgtgttcgggttattaattctccattttcacaactctgcattggcgcttccatccagcgtcgacagtacaggatgacccatttaggcatcccgtggtgttccagagctttgagcaccagatcatatatcacatcgttgaaacacgcgtttatgtccacttacagtatccaggtataacgccagcaccggatggcacattgtttcagagcgtcatgagctgatttgcctggtcggtaaccatatgaatcagcatggaaaatcgggtcaagcttttcttccatgaaaagttttatcgctccctgagcaattcgatcggatactgttgggatccccagaatgcgttccttgccattcgacttcgggatccgtttttccagcactggtggcggaaaccatgttcccgaacatagccggttccagatcttgtatagattgccatcacgttgctggtcgaacattttcaaagtctgcccgtcgcatccggggggctcccttgttgcgacgcacatccagatatgatgcccagaccagtgcttttggtatttcaaatgattttcgttgcatcagttacgtcatccccttttgggttgtgtcttctgcaatgaatgtgatccccatcccttcgctccagacccattacagatctttcatcactactacgaatgggtccgcccctgtttcccgatacgtgccggaaacaggttctcacgttccctgagatggtctggcccgggatcctgctgccttcacaccggatgccgcgcagtcagtaagcaggtgtcttctgcgcttatcaggggacggctgtacggccccattttggcatcatctaagatttcgatgcttcatcggacagtttactttcgttcagcttcccgaacccacgtgacagtagatctctgccttttcccggagtcgctcaccacctcattccttagaatgaagcagcaccgggtcgtttggtctgtgctcctgtaaaccctgaccggagggcccacctctacccacctcagagcatggataacttatgctgcaatttccgaaccggcgttacggtcatcacgaacgtagacccacagccgggcagtccttgttttaccgctgcccggctcctggaccggaacggggatatcatcggcatggactttaccgggcatcagcacatactggcgcaggatgtcatacagcggttccagcagttcagcaactgaaccgccccgggtttcctggagagtgttttatctgtgaactcaggctgccagatcatcgtttccgatggaagcataataagctttttctgcttctgccggaggagtatggcccagcctttccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgcatccggcaaacacatcaatgatgaacgccacatagacgaagccctgccatgtgctgacgtaagtaaaatcagccacccacagctggtcaggtcgttctgccacgaactgatggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgggcactgcgtttatccggatgatgtcgctgttgctgacagtggtaatacgttgacggggcaatatgcagttcactgcataccggtccgaccccgtactgctcacgcagcttatccagcagtggcattattttttccagaggcggtcgaactccgcctttgcaaaataagcggaagccaggcgaaggatattgttactgcggcgcagttcacgattttcacgttccggctctttcagacgctgacgttcagcggtggtgagccctccatcaccgcccccggtatcccgctcatgctggcgaacccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcattaagctttttgaatgcctgatcgagcatattctcgaccatgttcatcactggtctttccgaaaggctgtaagaaataacttcgttgttgaagagatctattactggagacaaatacagcttgcgcccattgactgcaaattcagtaaaatcggtaacccacttctcgtttggccgcgtagccttgaaatctcgttggagaacatagggggcggtttgccctacctctcctctgtaagagcggtatcgcttgaccttaatcgctgccttaagtgagaggattcccatcaggcgctgaaccacggcagcctgacggctgcaaattgaaaaccgcccctgttcgtcctgttgttgccgcacgctccgcagaatatgtatgctctgaggacctgttttattaaggactcatcctcttatgttgacccgcaaaagtatagataccgttctgctctctgttggtgctgagaagctctcacaacgtgaatgggactggatgaagatgctcaaacccatggacccaccacctgcgatggtcgcggcctccatcctggagcgccgtggcgacacagcagcccttacccggctacaggataccgggggttaatccgtcctcatgttgtccgcttttactccccgcccgctgaaacgtctgttcacggccaaccagtgctggacatccttcctggatgcgggcggtctgcgcgatatcgaggttgaggctgtcacaaaaatgctggcctgcggcacgcggatactgggcgtgaaggaatacatctgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcaccctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgcggacaggggtatcgcttagtttttcaatttcctatacgtgaacagctttatggttaatctgtttcccttctcgatgaagagacagcgttaccctacggtatccgtatcggcctctattctcatgataaatctcaccaatacgctttttaacgtccgcatacttgtcaggcttgctgagagcctttagatggtaataaaacgtactgcgcggtatctccgcagccctgagaagctcatcaagaggataaaactgccttagctcgttgagtactttcactttttcgtgggatgagctaaggctttcagcttttttagatacacaagccgcgtttcaagaaatcgaacttgcctttcaagatcctcaatgcgtcggtcttttgacagctccaatgctgatgccgctttttctggatcaactgatattgcaatgtttcttttggtgccaatcttgagcgcgcgtaaaccagcttctccgcgctcttcataaaccttcagccacctggctacagaaccactaccagcaagcataaagtgagcagcagcctgattaagggacatgtgctgctcaatcacagctttcacgaccttaatacgcaactctggatcagcactaacacctttaggtttgggaattaagcctttttctccatgtttttcatagagggcaacccatgtcctgacctgggttcgggggacaccaaaacgtgccgagatgatcctgtaaccatcatcagtagtgaagtagtgattcacgacttcaaggcgcttttcaaaagggtattttggctttgacatatcaggggctattccatttcatcgtccaacaaaatgggtgcagtacataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcatttaaaattttttatgatataagtaaaatttctttggagttataccataatattcattaaatttccttataaaataagatgggcttgatattccgataagtcttgatacatcattaatatagctttgactattcaataaaagctttgctgcatgatgcatgcgaatatcaagaaggatttgttgaaatgttaatttttcactctccaatcgttttctaacagctatttctgataaattcaagttatttgaaatatcagaaagacgccatctcttctcgatgtttttttcaacaatcttccttatctgatcagaaaaactaagagaagaagctatcgatatcgaagtatataaagcttcctcatcagaaacagctgataaaaggcaagctaaactatagatctttcttttgccgaaaggcatctcttttatagatttgaacaaatcgatagaaacctcctcctcagagaggaggaatatttttttgtttaacccccttttctcctcagaataggagtgttgaaatgaataaattggttccattattctaataatgcttaataataaatttctgtcaaggcttataatctcaaatggattaatgctatcagatttttttatggagacgtttatttgtatatttcgctctataaaagcaatttgcccttcatcgatagtcaaagtttcattgcctgagctaaccgtcattgaacacctttttgcatataaaataatatagttatgcaagcgaacctttatatctattttgtttttatgtcccatatccatcataaattcaacagaatataccaaactatatttagtgtttacagagtaactaagaaatttctgtaacagtgattgtatacaaaatctttccgttattaagatagattaagtaatttttcctatatttaactttatttacattttttgaagaaagagcttatgcagcttctatttctctgtgcaacaagctaagtatttgcactgaaagggactataaccatattatggtttcacttttcttaggcaatatctgtgtaaatgttcggaaaggagtggagcttcgcaaaactccagcatcataatatcctatacggaacgcataaagccccttcagactggaggctccacaaatccggttggtgttgatattggtaagcgttaaccgaatgccgcattgacgattctcccgatgacagcgttacgttccatattgcgatcgtgaagccatagactgggcagcaggcacgggagattatgacaaagcaacggtgcaggatgtcatgtcaggagcgatatggcgataaaggaccggaacggccaatccagtggccgataacggttcggcttatacggctcatgaaacacggcagttcgccagagagttgaatctggagccctgcacgacggcagtcagtagccctcagagtaatggaatagcagaacggttcatgaaaacgatgaaggaagactgcatcgcgttcatgccgaaaccaagaacggcattgcataaccttgcagtggcgatcgagcattacaatgaaaaccatccgcatagtgcgttgggttatctctcaccaagggaatatcgacgtcagcgggtaatgtcaacttaagatacaacgactgtctgaatatcgtgggtcaaggacagttcaatgacgtaacgcagccatttttctggctccacatctcatcgcttacgaaaaaagtatcgtttttttacagtaaacttcatttagccgactataatgtaaaaaataaattctttactaaaatataacataaggaagcaatatgcttacacaaactatattcccttgccttccacaaaaacaagaaaatatcatccttgaagtatcaaatcctgtattattatcttctactgttactacagatggatatactgttttcaataaaaaagcagctatatacgaattacaaatacctgctgccaaccggacgaaaacgttgaaattcactgctacagaaatgcaatggttgacaaagataaatgaagccggaattgatgaaaaacaaagccaacggtattctgatttctgaagttaatttcagactcgtttaagctccattttcaaaagaatatatcagggtttgttactaataatttctggaaacagaaaaagtagagcagtaattctatttcagagaggagtaactccatctatcctcgatacggtaatgctgccaacttattgatttagtgtatgatggtgattttaaggtgcttgcgtggcttccatttccatcagatgtccttcctgctccgctactgaaggcgtggtgcgtaacggcaaaagcactgccggacatcagcgcaatctctgctctcattgccgtaaaacatggcaactacagttcacttacaccgcctctcagcccggtacgcaccagaaaatcattgatatggccatgaatggcgtcggatgtcgcgccagtgcacgcattatgggcattggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccctcgatacatactgaacgttatcgtgatatatttatcatgctttcttcaccattattcgagtgcagggacgcaatgaccttaaataccttttagtagaatatattgctgacccacaaatatcaggatagtattgacaagtcatagatggagaaatatatgactgaattaccattctctggaataacagcagactccttcccatagacggcttaggggggtgtccctattaagttgtcaagcatgttatgacccctgcggggtataaaaagtcccgtcgcgcatcatggcgaacagaacgtcgcagcgtcgtctcgccagggcgataagcgcctgattgtgtcgttttccctgactcattttgcgggtgtagtaagccctggagagcggatccctgagcgcggtgaaggccgacaggaacaacgcccgtttgagagctttattaccccgtcgcgagggatgctcaccgcgtattgacgagccggatcgccgagttaccggcgcaaggccagcataagcagcgagatgtgcggcagaggcgaaggcgcggcaggcgacctcggtgaggagtctggctgcggtcctgacaccgactccgggcatactggtcaggaccgggtaaagagggtgagcaagaactcgctgttctacctcaagcgccacctcgtctctttgcttacgcagcgtgatgagctggagtgccagacgtggcagtactacggcagcggcattcgtgccgggaacgacgaccgtttgttcggccagtgcctgaactatgtctgctgcaacgcgtttaccccatacgaggcgcacgtttgcagacctgggctgccagctccttctcacccagcgaagcgagtttttctggtgagggatatcgctggagaagatcgagtaccgccgggtgctcaagtctcggaccgagaacgcgctccggtgccggatgtatctgggtcagaaggccgaggatacggttgctggcctgcgttgtctgtgcggcaagatcatcatcgaagccgcagagcatggagagttcggcgatttgctcgtcagccagtttcagcgtgcgtagcgcgtgaggcagggtacgggcagcttcggcaatgatggcagcgtcacgagcatcagttttagcttcaccggcgtgtaagtcggctatgcggcgcatggccagtccagggaggtatccgacaaggactccttctgagcgggcaacggcgacaggtaacgcaccgatggtagctggctgatcaacaaccagcagtatctgaccatgttgtttcaggtcagatattagcgacctgagtttgttttcgtcgttgggtaatgctttatcgaacaggcgtttacctgaacgattaatggcaacagcgtgatgcgtatctttaccgacatcaacgccgataaagacctggacggattcgtaatcgctggattcggtcattctgtctcccttgtatatgggttaaccagataaccacggggagcaggtaccggcatccacgttacagacggtcccggcaaaagtgcctgacctgacccctattagcggttaccagcgccccaccagacccggtgacatcaccccccggatcatggacgactgggggcagtaatcatgccgggtctggctggctaacaccccattataaggggtacgaataaagtaacgggggaaagcaatacctggagaaagagtacaaagcaaactgtattaaacttaataagttatattgtatttcactagagttcttatcgttgataagaaattctggttataatgattaaatcaacgaatatacaggtaatcggttctggtattatgcatcaaataaacaacatacactcgttaactctattttctttgcctgtgagtttgagtccatcttgtaatgaatattatttaaaagtctggagtgaatgggaaaggaacggtaccccaggcgagcaacgcaatatcgccttcaataggctgaaaatatgtttacaaaatcaagaggcagaattaaatttatctgagttagatttaaaaacattaccagatttaccgcctcagataacaacactggaaataagaaaaaacctattaacacatctccctgatttaccaccaatgcttaaggtaatacatgctcaatttaatcaactggaaagcttacctgccttacccgagacgttagaagagcttaatgcgggtgataacaagataaaagaattaccatttcttcctgaaaatctaactcatttacgggttcataataaccgattgcatattctgccactattgccaccggaactaaaattactggtagtttctggaaacagattagacagcattcccccctttccagataagcttgaagggctggctctggctaataattttatagaacaactaccggaattaccttttagtatgaacagggctgtgctaatgaataataatctgacaacacttccggaaagtgtcctgagattagctcagaatgccttcgtaaatgttgcaggtaatccattgtctggccataccatgcgtacactacaacaaataaccaccggaccagattattctggtcctcaaatatttttctctatgggaaattctgccacaatttccgctccagaacactccctggctgatgccgtgacagcatggttcccggaaaacaaacaatctgatgtatcacagatatggcatgcttttgaacatgaagagcatgccaacaccttttccgcgttccttgaccgcctttccgataccgtctctgcacgcaatacctccggattccgtgaacaggtcgctgcatggctggaaaaactcagtgcctctgcggagcttcgacagcagtctttcgctgttgctgctgatgccactgagagctgtgaggaccgtgtcgcgctcacatggaacaatctccggaaaaccctcctggtccatcaggcatcagaaggccttttcgataatgataccggcgctctgctctccctgggcagggaaatgttccgcctcgaaattctggaggacattgcccgggataaagtcagaactctccattttgtggatgagatagaagtctacctggccttccagaccatgctcgcagagaaacttcagctctctactgccgtgaaggaaatgcgtttctatggcgtgtcgggagtgacagcaaatgacctccgcactgccgaagccatggtcagaagccgtgaagagaatgaatttacggactggttctccctctggggaccatggcatgctgtactgaagcgtacggaagctgaccgctgggcgcaggcagaagagcagaagtatgagatgctggagaatgagtactctcagagggtggctgaccggctgaaagcatcaggtctgagcggtgatgcggatgcggagagggaagccggtgcacaggtgatgcgtgagactgaacagcagatttaccgtcagttgactgacgaggtactggcctgaaccgccccgggaatcctggagactaaacttcctgagaaagaggtaaacaggatgactaaaaatactcgtttttcccccgaagtccgtcaacgggcagtccgtatggttctggaaagtcagggagaatatgactcacaatgggcgacaatttgttccattgccccaaagattggctgtacgccggagactctgcgtgtctgggttcgccagcatgagcgggataccgggggcggtgatggagggctcaccaccgctgaacgtcagcgtctgaaagagccggagcgtgaaaatcgtgaactgcgccgcagtaacgatatccttcgccaggcttccgcttattttgcgaaggcggagttcgaccgcctctggaaaaaatgatgccactgctggataagctgcgtgagcagtacgggggcggaccgctatgcagcgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcggggcttcgtctatgtggcgttcatcattgatgtgtttgccggatgcatcgtggggtggcgggtctcatcgtccatgggcctgacattcgtgctggatgcactggagcaggcgttatgggcccgtcgaccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactaacgtgggtggactggtataacaatcgacgattgcaggaaaggctgggccacatccctccggcagaagcagaaaaagcttattatgcttccatcggaaacgatgatctggcagcctgagttcacagataaaacactctccaggaaacccggggcggttcaaccgacgataattccgttatctgccagctccgtctggagccgccgggttccatatgtttcgcgagtgcggatatgtgccaccttaatctccagttttagccgctcatcactttgttttctgtctgagggggcatgctgtacccggtcgtaataaccgctcctggatacaccaggtacccgacacatcgcttcaacagggaattgttgtcgccattgttcgactaacgcgtatttttcagcgactcctgtgcaaaatacgctgttgctttttttaatatatctcgctcaagtcgtgcttcatttaaagccttacgcagttgcataacttcagattccagctcagccactgtgcgggagcctggtgtattgagcccttttcttgcggcggtaacccattgtcctaaagtgccttcaggaacagataatcgggaagctccttcactgatcgaaagctgattttcaggaaccgttttgacggcttcggctttaaactccgtagagtaacgttgggtttttctgctcattattggctccttctgatgccattctatttcaggaaggagtgtccgttaaactcaggctacctcagactcagactttataaaacaaggtattaggtgccacaactgactgaacaaaaccaaaacgctcataaaatgctctggcgtcatcatcaattgcatgtaccataacagccttaatgccaacctgatcagccagattgacaacccggtgaatggcatcacttagtagccatttaccgaaaccatgcccctgggtacaaacatcaacagccagacgccctaacagaacaacagggacaggattgggcatgttatgccgcaaactgcgaccaagctcggcatgagtgacggaaccagtagctaatgagtagtatcccacaatacgtaaagtatcctccaagcaaataacgaacgtgcgagaagcattgagcatctggtttttcatagcccgaccacgtaaccagttacttagcacctcatttccacagtcaaatggctgaagtatatgctcatccgtcaacaatgctggcgcggtgacatttatttccattcaggctttaccgccatcagacgttcacgcccttctgcattctgcacaggagcttccagttgcgtaataaacgaatcataacgttcgttatccagcacaaataaacgttgatccaggataatgtttttagcttcctggtacgccagttccatgatgaaatcggtacggttcttattgaccaagctcgcagcataatcaataacggctcgttcctcatcagttgcccggatgttaatctgatgttctcgcggtgttttacggacgcttgcagctgtagacataaaaacctccattggtaacaatttgctatgcaattaatgttatcgcaaatggtaacagaacgctatacagaatcacttacgggaaaagcgatcccctgataaaaacaatggcagagacctgaacattgtgacgatgatctgtgtcggcgcacaaatcatgtctgattacggccgtttaatgtgattttgataatgaaatgcctgaaccacggcagcctggcggctgcaaatcggggtgtggcagaatatgagctttcagagtaaccatccagaatgagttcccatgtcacacaacctggagcaccagaaagtccacaccagaatggtgaaagaggttctgaaagccgtcgccagagccaataatcacccttataagtccgtatttgcagactttatcaccggtcatccctcctgcacggtctgtttctgggaaaccttccacaaaatgtacccggattcaccgtacgaatacgtcacgttctgccatacctgccgtcgttttgatttatacgaaacagaagcggagatgaaggcggatgacccgaagtggtggtgattttcagccccgaccgctgaaacgcctgttcacaaccaaccagtgctggacatccttcctggatgcgggcggtctgcgcgatatcgaggttgaggctgtcacaaaaatgctggcctgcggcacgcggatactgggcgtgaaggaatacatctgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcaccctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgcggacaggggtatcgcttagtttttcaatttcctatacgtgaacggtgctttgggcggctgaaagaatatcgccgcatcgccacgcgttacgacaaaacggcgagaaattacctggcgatggtgaaactgggctgcatccgactcttttatcaacgcttacgtaattaagggacacagcctagtctccaggattcccggggcgttcaccacatgcaatgtgttgttgcaggggaacggtctgcaccatcccctatatcgatcaatataacaaaaatgacaacgtcagattcagggcacaacctaaatatattttaggtcacctcccaaatcgtttgcctgataccgctccattttttaataaaaaatcaattgtttttgaatctttgcttttcattgcattgtcaagcatagtgtccccactatttgctttttgaaatcttttgtttacatcaaccaatccattactaataaaatattctagcactttatagttggcactatcttcactaagtaaatactcaacatcatacagctcacaatacatattgttgttcattttctccatctctgcgatatcttgttttgtaaaattaaatttagatagtaaataaagtgccatatcagattttgcattgcctagagaataagcaagagcttgatgagccatttttttatcagtcaccttattgttaatttcttcataattggatgctttaatggcatcctccaaagatatatctctgagtcttatctttttgaagttatctgtgcttagcattcttggtatatgatactcaagctgaaacacaaagtttataattctatccagactaacaggatcaatgtttttattataacaaaactctcggaatctttgatctttactctttcttataaaatcaataagatgcaacccaattccaagcctcatatctttagtattaaatattggcacatcagtttttccctgattaccatgcacatacctgctaacttcatccacaacctctttaaagttatctaagaaaaatgattggtgctcatggtaaaaaacaggtggaatagcattatcaaagtggtcggttaatgtcatatatccatatggagagtcatgatcaatgatatacgcattagcaccaaaatccacagtatgatgtgttttatttagtgggagtgtttcttgatgattggaaatttcaaccccaaaaaaaacaaaatcgtggttagctatttcttcaatatcctcagagaatgtgtttttatatgtttgtatattctcagacttaattttatcaaaggacttaatattaagagtattatttgacaggttagcgttactttgatgtctgaagttaaaatcagaattaataataatagagagcaagtgacgttcatccgaagaaagaggatgagttttttgtattatttcagaaagatagtgtctggacaccttatcgaggtgctcaagtgaccgaaatgatgaccgtgctccagatggcgcttcaatagaaagatttaatgatttgaaactggtcccttgagagaacattttactataactttgcgctgctatagacttccttaaaaagcttttcacagtatcagcacagtgatctaaatgtttttcacttatgccagaagaggatgagtttgttacgcatgatatgtttttttgtaatgcttttgtatctttgttcggatttatttttccatcaacaagatcaatattgttctgaacattaatatgatttactgcttcaggtattttcataaaacatcccccattatgtgcgtttttatctgcagttatttagaataatattatctaacttaatattttcttgtatgtattataacgaacatattttaatatgttgtacgattttcactctgaaatcccctgagtttaatcacacttcctttactgaaaggaattattgcaacagtattatttgtttttggatatatatcttgcgccttgttatgtagttaatgctcagaatatgatagataaaatagagacgcaaaacagggcatgctcataacatgatgataacataaaaaattagtaacaataaatgaaagaatcatgggcgctcaacaaaaagagggtaatgctgccaacttactgatttagtgtatgatggtgattttaaggtgcttgcgtagcttccatttccatcagatgtccttcctgctccgctactgaaggcgtggtgcgtaacggcaaaagcactgccggacatcagcgcaatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctggtacggaagtcactgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctgggttcgccagcatgagcgggataccgggggcggtgatggagggctcaccaccgctgaacgtcagcgtctgaaagagccggaacgtgaaaatcgtgaactgcgccgcagtaacaatatccttcgcctggcttccgcttattttgcaaaggcggagttcgaccgcctctggaaaaaataatgccactgctggataagctgcgtgagcagtacggggtcggaccggtatgcagtgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggtggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcagggcttcgtctatgtggcgttcatcattgatgtgtttgccggatgcatcgtggggtggcgggtctcatcgtccatggaaacgacattcgtgctggatgcactggagcaggcgttatgggcccgtcgaccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactaacgtgggtggactggtataacaatcgacgattgctggaaaggctgggccacatccctccggcagaagcagaaaaagcttattatgcttccatcggaaacgatgatctggcagcctgagttcacagataaaacactctccaggaaacccggggcggttcatgccgtcaggcagcagcgaagcaaagcgttactgacgtcgctgaatgaatggatggtggagaagaatggtacgctgtcgaaaaaatccagactgggcgaagcgttcagctatgtactgaatcagtgggatgccctctgttattacagtgatgacggtctggcggaggcggacaataacacagcagaaagagcgcttcgtaccgtctgtctcgggaaaaagaattacatgttcttcggcagcgatcatggaggcgatcgcggagctctgctgtacggactaatcgggagctgtcggttgaacggtatcgatccagaagcgtatctgcgccatatcctgagcgtactgccggaatggccttccaaccgagttgacgaactgctgccatggaacgtagttctcaccgataaataagcgtcaatacggccttccgttgacgcttacagaactcctgtggcgcgagagtgaaaaactgcgtcgttataaaaaggaggcccggttgccagttgccaaaacgctaagcgaatacgacttcattcagttgccggaactgaatggagctcagttccagcaactctgtgaaacgacagactgggttgatgctggagaaaacgttctgctgttcggggccagcgggttggggaaaagccatctggcggcagcgatcgtggatggcgtagtaggccagggctaccgggcccggttctacagcgcaggagagctgttgcaggaactacgtaaagccagagctcagttgaaactgaatgagctgctactgaaactggatcgctaccgggtgatagtggtggatgatcttggctatgtcaaacgcgacagcgccgaaacgggtgtgctgttcgagttaatagcgcatcgctatgaacgtgggagcctggtgataaccagtaaccatccgttcagcatgtggggcagcatcttcgtggatgagactatggcggtggcggcagcagaccgactgatccatcacggatatatgttcgaactgaaaggggaaagctacaggaaaaagacagcgaaggcagtaacaagcgtgacttgatgtcgcactgaaggggcggccagtatagttggcgccagtcggcaaaactagttgacgtctaatacctggacggtcacttctgagaaaaggcatttacacagaatcttaaacaggctcacggagttctttcagaaaaaggcctgccgaatggcagacctatcccattcgtcagaaaacataacggaagttggcgtttatcgcattatccacattatatttcccgaacgctgatttctccagctccagtcccaaacgcatattatccttaatttccgcattcatccctaccgtcatcagcatcctgctatctttttcaccttcgaaacgtttctctccggaagcatcctgcagaaccgtttctccgttcgccagcaggtcgaactgataacccagcccggctcgagctgtgattttccagtcgtctccggagaaggctcttcccacgtcaacaccagtacggccaatcagtgggttataatccttgtctttcatgctcagagccattccccggtcttcccagctaaaagcttttcctgatacagaaccgtaaaccagctctatctgtggctccacccaggactctttcgtcaggtggtaacgataaccaacttcagcaccggcataccaggaatgagagctgtagtcttttgttcccagtgaggcaaaattcgccgtgtgctgattatcatgatggagatatttaccaatcaggtcaaaataagctccggaattaaagagtgcagaggcatacagaccgccacccacggatttgttttttccactgaatgcgtggctgcttgcattgctgtccgtataggtcagcaatgcccccgtaaataaatccacaccgtccagctcatgctttctgtcgacaccaatctgaacgtgagtgtagttatcgctgtagtcaccatctgccgaaccggtaccattcattatgcgtgcccagacaccggcatccccctgagtatcccgcaggtcacccatacgtttgttcaggttattgacctctgtaaggaaggacttataacctgatgccataaagtcttttgcggctttcgaggctccggcatcagcggtagtctgatatcctgtcagcacccattttgtggcatcatccgttttttccgtgctgattactggcgtaacgttactgaaaccaatctgctgcgtaccggcagtgaacgttttctcatcactccctttcggtgcggtaattaacgtcacgctcatttcactggctggtttgtttaaaaagtcaaccaggacgctattattactgcctgacagtttgtctgtgacattcaactggtcagcccggctgttgttggtatgcatcaggaacgtggtattatctgcagaaagctcttttacttgtaaagtggcaaagtgtttcccgtcccccagttcaattcgcgagcccttagccttcagtgcaccggcctctgattttccgtcagagtaccacagagcattgatcatatttaccgtactctgtgcccccgtaatactgcctctcagaacagcgttatatcccttcattaaggagctgaataacggagagtccgtcttccctgcatcagcatcactgtctcccagattaatggttgccgcagtggttcctgcatgaatatccgaactcagatagcccatatttttaacagaaaagctggcgttatcttcgaggttaatcccttctgttgtagaaattacgggtgagtaatacccctgtttctgcgcagaaggcatccccgtcagggtcagagaagcattttcttttacatccacagccccggtgctgaaaataccgctctgagccgtaagttttgctccttttccgagggtcaggctgctgttgacaaagctgccaacacggtcaaaaacagcattctgagaggtcacactcacggtgctatcataagcctcaataccaccggtgaatctctccatgatttgcagggatgatttattttccagcgtaacatttccgctgtaatcactctggtcaccaactgtggttgcagtggcactcccttcaacagagaagaccgcattaccggttccgtcactcctgtcagtaaagacacggctacttcccagaatgactgtacttccattggtggcgttaatatctccctgcatcttgccgtttctggacagatggaatgttgccgcatcgagtttcagtttttccagcgtaaactgacgggtttcccagtcgctctggctggaagaagtcgtcgttccagcatgaataactggatgaccctggaatatcagcgtgccggacttcttggttatcgaaccttctggcaggttaactgaaccatcaagagccagtacatccttacctgagagctgcggaatattcacatccatattgccgtttagttggccgtgatacatataaggctggctgctggcctcaattttttgttgcttcacagtatcaatggctttattacgatcttttccgacattctgccagacactgctgttgttcagatcggagaagaacggggaatatgaactcgctttcaggatgaaatattgcttggtagaactgtcataatataggtctcccggcgctcctctccccccaaaaatactgacagtattaaccggtacattgatgtcactggcttttaatgtctgaaggtcgagtgttaccgttgattttttctcactgttattggtaatgatggccccgtagtcagccgcctgaagacgggtaaaggtcagattattaccattcagttccagacgtcctccacggtatccccacgaaatattatccggattaacttgctgtgagtcagaaagcacaactgtcggacgaccgctggcaataccaacagagctgaaagcctgtacctttccgtcagcatccgcctgctggttgagaataacggtaccgtcccccaccttgagtccgcctgcattcacaccggtcccgtttactgtcagggtaccttcgccagttttatgcaggttatcaccggcaactccgttcacctgccacagaacgtgggttcctttatcggtgataatcccgccccccatccatgtctggccgttcagggcggacaccctgtaatcgccggcaaactgcagatacccagctccctgattaacggaattctgcagaacgacctcgccattattgccggtgaacaggaggttttttcctgcgttcagatcatttcctttctttccatgcatatcccaagtcgtgtttccctgagtcagtgtgccggtgccattagccgcatcatatttccactgcagtactccttcaccagaggtgtaggctatagttttgtcaaaatcattttgcggttgctgaccaaggaaatcctgagtggtgacgacccagttatttccatagttagttcctgaggaaagcacgccaatcagtacccattttttttgcagggaatcataagcaaacaggggggagccgctgtcccccatattcagataattagccagaggtccattcgcgggattaaaaatgtcaccggtctgagctgtaatcatctgtccgttgttataggagttcagcgcgctgacggttcccccaacaagaaatccgccattggtatacacttgggtgcgattaccatttttgtctttgacgtactgcatcccccccccaaggcgatagaattcagtaaagcgtccgccggcctgataggcaccgctcacagccccgatgtcagacacttctgccggcgccacctctgtcaccagtttactcaggcggcgggttttaatatcaagaccgctattattatttgtaccaaccgcagtataggtgtttttggcgtatccgaagctcatcgtgtcagaaccgctgacatgtttggcggtaaccacatactgaggggagtaaagtgtatggtctcccggaggcaggctaccggtagtaatagtggcactactgaaatcagccatcggggctttatcaagtttaccgaccagattgccctgcttgtcgtaaatggaaatattcgtggtccccggcgtaaactgacctttattctcggcaaagtcgcggaatatctgataagggatctctgcactgaccgttgctgacagagctggccatgccgaggaaagtgataaagctgcaacagacgtaagaataacccgacgtgaaagtctgcgatggcttttgcaggtaaccctgcgggccagttcggagacagcaatcaggcttttggttatatggcaatacttaagataatatattttgttcatatagaaacatcaacctaattttgacaaagattaattacataggatgtagatggagcagtccgagattctactaatatcaattattaagcatctgttttttagttggtgtaatataatttttattaaggtaagcggaaaaacaaccaaaaaaaacgcaagatgttatttttttatcattttgagccagtttggctggggggatactcttctcttaagcttcttgctcaactttaaaaatagttatgccagttcggtatcgataaggggcagtttggatatcgagaaccacggcagcctgacggctgcaaattgaaaactgcccctgttcgtcctggtgttgccgcacgctccgcagaatatgtatgctctgaggacctgttttattaaggactcatcctcttatgttgacccgcaaaagtatagataccgttctgctctctgttggtgctgagaagctctcacaacgtgaatgggactggatgaagatgctcaaacccatggacccaccacctgcgatggtcgcggcctccatcctggagcgccgtggcgacacagcagcccttacccggctacaggataccgggggttaatccgtcctcatgttgtccgcttttactccccgcccgctgaaacgtctgttcacggccaaccagtgctggacatccttcctggatgcgggcggtctgcgcgatatcgaggttgaggctgtcacaaaaatgctggcctgcggcacgcggatactgggcgtgaaggaatacatctgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcaccctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaatcagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgtggacagcggtatcgtctggtttttcaatttcctatacgtgaactatggctcgctacgaccttcccgattaggcatggaccatcatcaagcctctgttacctcctgaacccgccacaccacgggccggacgcccatgggctgagcaccgtaaaatcatcaatggcatgttctgggtgttatgttccagtgcaccatggcgcgatttacccgaacgatatggggcatggaaaactgtttataaccgctttaaccgatggtcaaagtcaggcgtgattaatattattttcaacaggttgctttcgctacttgatgcaaacggctttattgactggtctgccaccgcgctggatggcagtaatatccgggcgctgaaatgtgccgccggtgctcaaaaaaacatcccgatatcgacggagataatgggccgggtcgctctcgcggcggttttggcaccaaaatccatctggcaacagacggaagtggcctcccgttaaatatcgtgctaagccccggacaagctcatgaaagccagttcgcgcaacgacttctggacgggattggcgttcagcgtcagaacggcagcatgaaacgccgtggacatgcggtactggctgataaagcgtattcagggcgcgcattgcgcaacgagctgaaaaataacggtataaaggcagtaatcccccgaaagtcaaatgagaaaatggcatcggatggacgtgcacagcttgatcgtgatgcgtactgcaaccgtaatgtcgttgaacggtgctttgggcggctgaaagaatatcgccgcatcgccacgcgttacgacaaaacggcgagaaattacctggcgatggtgaaactgggctgcatccgactcttttatcaacgcttacgtaattaagggacacagcctaaatagctgcgcggaatagtagatccctttgagggaacttagcccggattgtgcgatctgatcaatcgccaaatcaaaacaaatcaccaaccggactgagcaatgccgatcatagcaccaatttcccgtgacgaacgacgcctgatgcagaaagccatccataaaacacacgataaaaattatgcccgcagactgactgccatgctgatgctgcaccggggcgaccgtgtcagcgacgttgccagaacgctctgctgcgcccgctcctctgttggacgctggattaactggttcacgcagtcgggtgttgagggactgaaatcattacctgccgggcgtgcccgtcgctggccgtttgagcatatctgcacactgttacgtgagctggtaaaacattctcccggcgactttggctaccagcgttcacgctggagtacagaactgctggcaataaaaatcaatgagataaccggttgccagttaaatgccggaaccgttcgccgctggttgccgtctgtggggattgtgtggcgaagggctgcgccaactctgcgtatccgtgacccgcataaagatgaaaagatggcagcaatccataaagcactggacgaatgcagcgcagagcatccggtcttttatgaagatgaagtggatatccatcttcatcccaaaatcggtgcggactggcaactgcgcggacagcaaaaacgggtggtcacgccgggacagaatgaaaaatattatctggccggagcgctgcacagcgggacaggtaaagtcagctatgtgggcggcaacagcaaaagttcggcgctgttcatcagcctgctgaagcggcttaaagcgacataccgtcgtgcgaaaaccatcacgctgatcgtggacaactacattatccacaaaagccgggaaacacagagctggctgaaggagaacccgaagttcaggggcatttatcagccggtttactcgccatgggtgaatcatgttgaacggctatggcaggcacttcacgacacaataacgcgtaatcatcagtgccgctcaatgtggcaactgttgaaaaaagttcgccattttatggaaaccgtcagcccattccccggaggcaaacatgggctggcaaaagtgtagcggtattaagcgcagctatttagattattgccgcattttctccaccacgatcagagccgaaaaaagataatttttttccaactgccacccggcgtaatgcgttttcaccaatgttaccccacctattgcggcaaaaggtaatgtcttcaatcgatagaagtttctggtaatctactggtatttgaggttttccatgactaccgttactgttcattgtccgcgctgtaattccgatgaagtttatcgacatggccgtagttgttcccggcatgagcgtttccgttgtcgctcatgtaaacgtgttttccagctcacttactcttatgaagccagaaaactcggcgttaaggagcagatcgttgaaatggcacataacggcgcagggggccgtgataccgccaggacactgaaaatcggcatcaataccgtcatacggacattaaaaagctctcgccccggcggataacatctgcgccagtcgctcacgctgatgttgcccttatctgtgaacttgatgagcagtggcgcttcgttggcagcaaggcgcaacaacactggccctggtatgcgtacaacactaaaactggcggtgtgttggcttacacttgcgggccacggaatgatgagacctgtcgggaactgttagccctgttgactccgttctgtatcggcatggtgaccagcgatgactggggcagctacgccagagaagtgccggaggagaaacacctgaccggcaaaatcttcacgcaacgtatgaacgtaacaacctgaccctccgcccccgcatcaagcggctggcacgtaaaacaatctgcttctcgcgttccgtggaaatccacgaaaaagtcatcggttccttcattgaaaagcacatattctaatgattggaagtactacccggcaaaactcattcagtgcattccagtgattcaggatatagttgaacgcctttaccatttcagcatggtttgacaaagttttcctctggagctttatccagtcatacaaggacttcattcgcggcacacatttctcctgcctgaccgcaagccgtttttctgccggcctccctcgtattaaatgtgtatcgtttttttacagtaattttaatttgtcattctataataggaataaatgagcttgactaaaatatgatgtaaaacaaatatacttactcggcttacatttccttgctcactggaatgttgaattcagtgttattattgactgcagccacaataaaaaaagaattccatagaaaacctccataaataaattacaactaacttctgttatgtgtaaaatggaaactattaaaacttaatatcggaaatggtaagtgaaatttgtataaatatacaattttaaatatttattctcacaaatataaggttgacctagcattatgttctctgtaaataatacacactcatcagtttcttgctccccctctattaactcaaactcaaccagtaatgaacattatctgagaatcctgactgaatgggaaaagaactcttctcccggggaagagcgaggcattgcttttaacagactctcccagtgctttcagaatcaagaagcagtattaaatttatcagacctaaatttgacgtctcttcccgaattaccaaagcatatttctgctttgattgtagaaaataataaattaacatcattgccaaagctgcctgcatttcttaaagaacttaatgctgataataacaggctttctgtgataccagaacttcctgagtcattaacaactttaagtgttcgttctaatcaactggaaaaccttcctgttttgccaaaccatttaacatcattatttgttgaaaataacaggctatataacttaccggctcttcccgaaaaattgaaatttttacatgtttattataacaggctgacaacattacccgacttaccggataaactggaaattctctgtgctcagcgcaataatctggttacttttcctcaattttctgatagaaacaatatcagacaaaaggaatattattttcattttaatcagataaccactcttccggagagtttttcacaattagattcaagttacaggattaatatttcagggaatccattgtcgactcgcgttctgcaatccctgcaaagattaacctcttcgccggactaccacggcccacagatttacttctccatgagtgacggacaacagaatacactccatcgccccctggctgatgccgtgacagcatggttcccggaaaacaaacaatctgatgtatcacagatatggcatgcttttgaacatgaagagcatgccaacaccttttccgcgttccttgaccgcctttccgataccgtctctgcacgcaatacctccggattccgtgaacaggtcgctgcatggctggaaaaactcagtgcctctgcggagcttcgacagcagtctttcgctgttgctgctgatgccactgagagctgtgaggaccgtgtcgcgctcacatggaacaatctccggaaaaccctcctggtccatcaggcatcagaaggccttttcgataatgataccggcgctctgctctccctgggcagggaaatgttccgcctcgaaattctggaggacattgcccgggataaagtcagaactctccattttgtggatgagatagaagtctacctggccttccagaccatgctcgcagagaaacttcagctctctactgccgtgaaggaaatgcgtttctatggcgtgtcgggagtgacagcaaatgacctccgcactgccgaagccatggtcagaagccgtgaagagaatgaatttacggactggttctccctctggggaccatggcatgctgtactgaagcgtacggaagctgaccgctgggcgcaggcagaagagcagaagtatgagatgctggagaatgagtactctcagagggtggctgaccggctgaaagcatcaggtctgagcggtgatgcggatgcggagagggaagccggtgcacaggtgatgcgtgagactgaacagcagatttaccgtcagttgactgacgaggtactggccctgcgattgtctgaaaacggctcacgactgcaccattcataatcacgtcgcataagcataaaccgcagaccggattgactccggaaaaactgtgacccgattacggaccttaacaacaacccgtaaatcctcgctcaataccggcagggatttacggcgtgcaactgacttttttgaggggataaccaaccagatcgtttgctatgggaatatcgagacagtaatgagttaaatgataaaaattgtttgaaaatataggggataaagatcaatccaaactggatgaaagtagaactggtcacattaacatgggtagactgatataacaatcgacggttactggaaagacaggaacatattcctccagccggaatgaaaacgccgataaagctctaggattgtttttttaaagactttctcgttttatttgcattaatagaccaagatatgaatagtgaggggttaataaatgaaaccgatcaacaatcattctttttttcgttccctttgtggcttatcatgtatatctcgtttatcggtagaagaacagtgtaccagagattaccaccgcatctgggatgactgggctagggaaggaacaacaacagaaaatcgcatccaggcggttcgattattgaaaatatgtctggatacccgggagcctgttctcaatttaagcttactgaaactacgttctttaccaccactccctttgcatatacgtgaacttaatatttccaacaatgagttaatctccctacctgaaaattctccgcttttgacagaacttcatgtaaatggtaacaacttgaatatactcccgacacttccatctcaactgattaagcttaatatttcattcaatcgaaatttgtcatgtctgccatcattaccaccatatttacaatcactctcggcacgttttaatagtctggagacgttaccagagcttccatcaacgctaacaatattacgtattgaaggtaatcgccttactgtcttgcctgaattgcctcatagactacaagaactctttgtttccggcaacagactacaggaactaccagaatttcctcagagcttaaaatatttgaaggtaggtgaaaatcaactacgcagattatccagattaccgcaagaactattggcactggatgtttccaacaacctactaacttcattacccgaaaatataatcacattgcccatttgtacgaatgttaacatttcagggaatccattgtcgactcacgttctgcaatccctgcaaagattaacctcttcgccggactaccacggcccgcagatttacttctccatgagtgacggacaacagaatacactccatcgccccctggctgatgccgtgacagcatggttcccggaaaacaaacaatctgatgtatcacagatatggcatgcttttgaacatgaagagcatgccaacaccttttccgcgttccttgaccgcctttccgataccgtctctgcacgcaatacctccggattccgtgaacaggtcgctgcatggctggaaaaactcagtgcctctgcggagcttcgacagcagtctttcgctgttgctgctgatgccactgagagctgtgaggaccgtgtcgcgctcacatggaacaatctccggaaaaccctcctggtccatcaggcatcagaaggccttttcgataatgataccggcgctctgctctccctgggcagggaaatgttccgcctcgaaattctggaggacattgcccgggataaagtcagaactctccattttgtggatgagatagaagtctacctggccttccagaccatgctcgcagagaaacttcagctctctactgccgtgaaggaaatgcgtttctatggcgtgtcgggagtgacagcaaatgacctccgcactgccgaagccatggtcagaagccgtgaagagaatgaatttacggactggttctccctctggggaccatggcatgctgtactgaagcgtacggaagctgaccgctgggcgcaggcagaagagcagaagtatgagatgctggagaatgagtactctcagagggtggctgaccggctgaaagcatcaggtctgagcggtgatgcggatgcggagagggaagccggtgcacaggtgatgcgtgagactgaacagcagatttaccgtcagttgactgacgaggtactggcctgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctggggtcgccagcatgagcgggataccgggggcggtgatggagggctcatcaccgctgaacgtcagcgtctgaaagagccggaacgtgaaaatcgtgaactgcgccgcagtaacaatatccttcgcctggcttccgcttattttgcaaaggcggagttcgaccgcctctggaaaaaataatgccactgctggataagctgcgtgagcagtacggggtcggaccggtatgcagcgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcggggcttcgtctatgtggcgttcatcattgatgtgtttgccggatacatcgtggggtggcgggtctcatcgtccatggaaacgacattcgtgctggatgcactggagcaggcgttatgggcccgtcgaccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctggaaaggctgggccatactcctccggcagaagcagaaaagcttattatgcttccatcggaaacgatgatctggcagcctgagttcacagataaaacactctccaggaaacccggggcggttcagtgaacctcgatcggtgtggtggattagcccggcaggtgggcgctggctcctgagcgccataaacagggctttacccgtcaactctttcgtcatgcgctctcccatggcgtaaccgacaatttcgcacgtataaacatctttgacgccagcgagatacagccatccttcccgggtggcaacatacgttatatctgcgacccagacctgattaggggggttggggagcaatggaacagtaaacgccgttaagaagtcaatttaaatagccaaaaattaactagccaatttacattgcaggttgtaatttttaaccaccttttttacgatagccaaattacctatacccatcccggccctgccaagccatacccgctatcggcgatgaaaatgcttttgtgcgcggtcggagtggtcccgacgagggttttacccgaagtcggggcgtatctccgcgttagcgggccgtgagggccgcttacgagcgtgtatgagagacgtacagtggttttgtccgctcacaccagtacatacaggtacggaaataaaaccagtcgaaatgccggtaacgacgattactcctgtctctgatgccggtggactacaagattttatttactggcgtcctgatgcggacagggctggtatggaacctgtttatgtgatacttaatgatcctctggattccgggcgatttacgcgtaaacaactaaataaaaatatcttaaacatgcaagtaattttggtattctcgatacaagaataaatagtagtaactactatagctgcaaataatgttaaaaacatttctatgatcatctttacatttttcatgattgacaattgtttttggttaaaaaaagacaactaatgagtgtgataatgcaatactttgagtgattatataatgataagtaaacaggtttgcgacaattggttatcagtattacagaaggattaaatatgtcattattcacagaacctaaggaaattgaaagattaccctctgaagagattgaacgattatatcccgtcctgcgatacagggtctttatcagcattttcctcggatatatggggtattattttgtccgaaacaccaccagtgtgttatccggtgtgctgcacatgtctgcaaccgagatcggcattatctcctgtgccggttttttatcctatggtatatcaaagtttgtttccggacttatttctgacagaagtaattcaaaagtatttttgtctcttggtttattcctgtccggactggtaaattttctgataggatatattcccgggatcatcacatccgttacgttattttcaacaatgtatttacttaacggctggatccaaggtatgggatatcctcctggtgccaaaacactggtgttctggtatgaacatcgggaaaggatcacctgggccacactgtggaatttatcgcacaatgtcgggggagctctggcccccgttctgattggtttcagttttggttttttcggcgacagtgctctggatcatgcccgggccgcatttatcttcccaggagtactgtgtatggcaatgagtgtgctgatttactttattcaggtggacagacctgtatcagtggggcttcctcccattgaagaatggaaaggtaacgtcgtttcacacccggctaaaggccgtgaacaaggtccgagactctccattcctgatatcatcagaaaacatatcatccgaaataataaactcatttactgctgtatctatggttcgtttgtttatattctgagatacggtattgtttcctgggctcctaagtttttaagtgacagtctggatgtcggtggtaaggatatgggaaaactggcatcaatgggggggggttctgtttttgaaatcggtggtgtggctggtatgcttcttgccggatacctgtctgtcagactgttcagaaactcaaaaccattaacaaatactttatttctggcacttaccattattttattaatcgcgtactggtacgtgccatcaggcaatgaatatctctggctaaactatacaatccttattctgttggggctggcagtgtatggtccggtgatgtttattggtctttattcaatggagcttgttcctaaagaagctgccggagccgcatcagggctgtcaggcacattttcctatatcttcggctcaattgttgcgacactgggaatgggacttgttgtcgattatctgggatggggggccacatttatcgtactgatactgtctgctgtttttgccatcattttcacactgatgagtcgtgaacgctcactggagttcgaaaaagagtaattttctcaggaaaaacataaaattactgactaaatatttattttttgaatcgcagggcattccggataaggttgatatcgtgtcacggctgaagacctatggatacagtatttctggtgtggagacggatgacggatataaggcgcttgtccgcgcttttcagcttcatttccggcagaaaaattatgacggcataatggatgctgaaaccgctgccatcctgtatgcattgctggagaagtatttcccgggtaaataaggagtgagtcgtcagagctgcgatatatctccttcctccatgggctgtctcttatacacaaatccccacccggggatttgtgatgtcagatgtccccagtaagactatgttttcattgcgctctatgaagctgagtgctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcagcttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcagagctgagtgagcgtaacgactggagctgcttctgcggtgctccggtggcgaacgtgaagtcatactcttcgaacattttcaccgccgggaaggctgccattcgggtatacatcgcctgtttacgttgatgacgtgccagtttttcttcatgaagcatgatgctccaagtaaacgttcaccgaacaccgtattgacgattatcctgatggtagcaccaccttccatggcaggaggtcgtcaactcggttggaaggccattccggcagtacgctcagaatatggcgcagatacgcttccggatcgataccgttcagacggcaggtgccgatcagcccgtacagcagtgcaccacgctcgccgccgtgatcgctaccgaagaacacgtaatttttctttccgagacagactgcacgaagcgctctttccgctgtgttattgtccgcctccgccagaccgtcatcactgtaataacagagggcgtcccactgattcagtacatagctgaatgcttcgcccagtctggattttttcgacagcgtgccattcttctccaccatccattcatgcagcgacgtcagtaacgctttgcttcgctgctgcctgactgcaagacactctgactctggtaatccccgtatttcatcctcgatggcgtacagttcactgattcgcttcagggcttcttctgccgtcgcacgcaagtaatccggggcccgctatgccgcgctctatcgggcgggacggggctggcgctttgaaccgccccgggtttcctggagagtgttttatctgtgaactcaggctgccagatcatcgtttccgatggaagcataataagcttttctgcttctgccggaggagtatggcccagcctttccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgtatccggcaaacacatcaatgatgaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgggcactgcgtttatccggatgatgtcgctgttgctgacagtggtaatacgttgacggggcaatatgcagttcgctgcatagcggtccgaccccgtactgctcacgcagcttatccagcagtggcatcattttttccagaggcggtcgaactccgccttcgcaaaataagcggaagcctggcgaaggatatcgttactgcggcgcagttcacgattttcacgctccggctctttcagacgctgacgttcagcggtggtgagccctccatcaccgcccccggtatcccgctcatgctggcgaccccagacacgcagagtctccggcgtacagccaatctttggagcaatggaacaaattgtcgcccattgtgagtcatattcgccctgactttccagaaccatacggactgcccgttgacggacttcgggagaaaaacgagtatttttagtcatcctgtttacctctttctcaggaagtttagtctccaggattcccggggcggttcacccgattatctgttcctgaaggcactttaggacaatgggttaccgccgcaagaaaaggactcaatacaccaggctcccgcacatgtcacgaacggtgcaatagtgatccacacccaacgcctgaaatcagatctagggggtaattaagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgtaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaaactgttcttccaggtcatcgctaaacgttacgaaaagagcgcaatgatcctgacatccaatctaccgttcgggcagtgggatcaaacgttcgccggtgatgcagcactgacctcagcgatgctgggccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacatctgtcagtaatgaatcgctgctacccgacagcacggaagtaagctgccgggcggggacggaagtgtgaggtatttcaggggcagacacccgacatcccagaaaccgtcggtcccgtccggggccggcacccaggttcacgtataggaaattgaaaaaccagacgataccgctgtccacgccttatgccacgtgagcttttctgcttttccctccactccggtgttttctctctctgcatggtcgattcttataccgcaacaggctgttttttatacttgcaccgattcccgggcacacttagcctgtgtcaggccggcatatacctcagcagactgatatcccgcgcgtttttcttcagcccctccacattcagtcccgcgatggcccggcggtataccatccggccgccacacagcacgcattcgaacgggtcacgactcaggaactgtttcaccatttgtgcatagcacactttcgccactggttccggtttatccatccccagagcacggtacacctgcggcagcttctctccacacacccggttggcaaggaacccgaagtacctcaccatcttaaaaaacttctccgggatgtgctgtttcagcctcgcgaccagctcacgctgtgtcctgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcaggctgtgtcagcgtttccgtcgccgtttctcccgttttgtggtccaggtaacggaagctcaggctcgcccctccgttgtaatgtgccagccgggaggccgctatcggcggcttcttcagataacgacccaggtagcgcgccgtattcctcccgccggccgtttttttcgacatgtacacatgccagtattttcctccggctttcagcaccaggcttctcctctgtgattccgtcgtgatatgtgacaacgactccggcatcgccagcccctctgaccacgctttcagaagccgttgccgcatattccacatccaccgcgaacgcatcgcgtctttcaggaagctcagctttttccactgaccatgcttattcagacctccacaggttacagacacatgtacatgcggatgccagttgagacgacggccatacgtgtggatggcgcagaagataccgggttcctgcccccgtttccgggcggcatacagcagattctccaccgccagacggcacacgtcattcagcagccaccggttgctttcgaacaccggccactgcgtgtccggcagggtgaagaccaggtgtacccagtcgcagtcaggaagacgattcagctgtgtcgctatccacaggtctgtggccttttttccgcaggacgggcaggcacggctgccgcatgagttagtgacgtatctgacgtgggggcactcaggtttatcgcagatgtattccttcacgcccagtatccgcgtgccgcaggccagcatttttgtgacagcctcaacctcgatatcgcgcagaccgcccgcatccaggaaggatgtccagcactggttggttgtgaacaggcgtttcagcggtcggggctgaaaatcaccaccacttcgggtcatccgccttcatctccgcttctgtttcgtataaatcaaaacgacggcaggtatggcagaacgtgacgtattcgtacggtgaatccgggtacattttgtggaaggtttcccagaaacagaccgtgcaggagggatgaccggtgataaagtctgcaaatacggacttataagggtgattattggctctggcgacggctttcagaacctctttcaccattctggtgtggactttctggtgctccaggttgtgtgacatgggaactcattctggatggttactctgaaagctcatattctgccacaccccgatttgcagccgccaggctgccgtggttcacagataaaacactctccaggaaacccggggcggttcactgcgtgtctgggttcgccagcatgagcgggataccgggggcggttcacacgaacataccacagacagttgattttggtacgcccaggcgacgtccggccacaacccgtggtaaatgttcttcgaaatgaaggcgtaaagcttcagtgatccaggtccggtattccatacgatagtgtccacttcaaaatgatggacattatttttgtggaaccggaggtaacagaccagacggtttaaatgagccggttacctcaaattcagtgtatcaccacgagataatattcagctttttatattcttcataatttctagaaaatcacttccattttttttgtccaagtgttctgctatttcttcaggtgtaatattttcattttttattattcccatataagtttttattgcctcaaaattcctattttgaaaagctataattaatccagataccccatttgggccttctgctgccagtaattttgatgcctgatgtggagtaaggtctgcagtgtgaagtattttcccataagcaataattgtttctacacatccattatgcaaggctacaaacaatccagataaaccattagaatctttcgcttctaacagctctgcttttttatccaagttaagttttgcctcattcaagatatcaccataagctaagattgcatcagcctgtccattattcaatgctaacagaagtccgggaacattgtcatatctccttgaggccagcaaatttacaatatcctctgagttgaggagaggggggctaagaatgagctcaccgtatgcgcgtatagcatctgcatgtccattttgaagagcaaacattagtccgggtatctgtctgtgtacttcatcataataataagcggtcagcaaatttttcagcttattgtattcgatatttattgctctcttcttgagaagccttccgtatgttttgatagtttctgcatgcccattttgaagtgcttgggataaacccgatattcgtcctcccattccttccgcagttagtagttctaccgttttatcaaggttaagtccagaagtttccaagagttctccgtatgctaagattgtatctgaatgcccattttgtaaagctaaaagcaatcctgacaaaccatcgtcatttttggctgccaaaagtaattctaacgtattgtctgaaaggtcagatagttgtacgactcttgttactttttggattagctcagtcaatcccatacgcatcgcgtgataaataactttggggtgaagtaaattatcaggccatctgattatggaggacatgcttgttggagtatgtctgtccacaaatatagacataccgtcggatataagaccataacatttctgatgtttttcatcaagaaaattatctacagtcagtttttttattttagctaagttaaatttgttaaactctgctcgtaaatgagttgctgtatggttgggatcataaagctgaatgacaaaatcccccccatttttagtttctttaatcttcaagcctaatgccatattgtgatttgatgtacttatttctagtgctctgcttttttcggaatgaaaaatcatttcattgaaaatataaaaaataatatctccccatgaaccgttttcaacaaaataaataatagcaggcacattaatagccttttcttcttcactcactgaaacataatttttaatttcatccggaaaagcaaagtgatgataatccacgtgaccactacttttgttaaactgtgctatccagtaggaagctaaatgtcgacagacaataagtcttccagagtgatcggtaacttggcaatttagatttaataaaaaactcctcttgtcagaaaaatatggcaattgttttgagtgcaatagagactggattgtctcaacagagacgttgtctttatttatcatattttgcaaacatattttccttgatgggattaaatttactgatggcatatgtatatattcctttcattgatgggttgtgacgcagacttagtgttgttgtactctttgccctttggatgattgatggcaaagattgatgtggtttgtcaccgttactctgaaactcaggggggtatccggaacggccattccagttcaggggggctgctctatcgctgtaagcagtgcctgaagaccttccagttcgactaccgctacaacggggcgaaacccatcaaactttccaactattatcacattgagccatactgacaataaacaatatatcgatattttgtgcaaatactgccttttgctaaacgatattcaattttgattaaatatatttattgtcagatgttgcaccatatttcaataatagttttatcatttctgcattctcatattttattgcgttatccaacatacaatccccactattagtttttttgaactttgtgtttacatcaaccaatcccttattgataaaatactcaagtactttacagcttgaattatgagcgctaagtagatactcaatatcatacaactcatgctttatggaaataacatcttgtctagttatctcaaaattagataatatatataaggcgacatcctctttttgattagtaatcgaaagaaaaagagcctggagagcaatttttttgttagtgacctgcttgttaatttcttcgtaattagatgctgtaacagcctcctctaaggatatttctctaatcttaacttttttgaagttttctgtacttaccatcctaggtatatggtactctggctgaaaaacaaagtttatgattctatccagatccacaggggcaagattttttccatagcaaaactccttgaagctttggtcttcactttttctaataaagtcaatcaggtataatccgagccctaacttcatatctttagtattgaatattggtacatctataattcctttacttccatgtacgtatcgactaacttctttattaacctctgaaaatttatctaaaaatgattggtgctcatggtaaaaaacaggtggaatagcattatcaaagtgatcggttaatgtcatatatccatatggagagtcatgatcaatgatatacgcatttgcaccaaaatcaacagtgtgatgttttgtattcagggggtgttttttctgatggttagagatttcaacgccaaaaaacacaaagtcatgattagctattttttttatatcatcagcgtatgtgtttcgttttgtgcatattccttcagactgaattttattgaatgacttaatgtttaaaattttatcagacaaatcagaattactttgatgtctgaagattaaatcagaattaataattagcgaaagcaaattgagttcctctgcagaaagaggatgaagtttttcccttatttcagatatataatgcttcgataatctgtcaaggtgctcaatagccttaaatgaggctttagcgtctgatggtgcatcaattgctatatttaaagatttaaagttagagccttgagagaacattctactataactctgtgctgctatagttttcctaaagaaacttttaataatatttgcactatcttttaaatttttttcatctggcatagtttgttgtgcagcgtttcgcactgatgtcacttttggaaacaatgtatgtaatctgttatccatagaatctatattgcattgggtatttgctgagttcagtgtttctgatatattcataaaatgaaccttatatgaaaacagttttaattaatatctttccctacaagatatagcagggtatgaattacaatttttgagtatatatacaatatactgcatgtaattagataagagtattatatacttttgatgttatgtgatgccagatatttcaaaatatctaaaatccgatgcttaagaactcaagttaatcttttttgtgaaattattttcataatttaataactatatcaattttattgaacagcaatgaattttactataaaaaaacgatactttctctgattcctcttatggagtgcttccagttagtggaatgtgtattctgcaatgaaatcctcgatgattttttcatgaagctcaactaagtgtgaaaaactgatgttttttaatagaggttagtttggccatatataattattgtacttttgcagtttttttgttacttcccttatgagttcaaaatcgccttaatggagcagtcactgcaacccagagcctgtgtggcgtagatcgcccgtgaaaatggaatctgccgttcggtttttgcgcgaagtttttctgagcttttaccgaactgcatacgctgcagtttcgcaaccagcgccttcagtcggttgatttcggaagcataagccgccatccgctgtgagagcaggcggttgtattcagccatctggtggatagtgtcctgttgcgtctgcaacagtgcccgcaggcgggcgttctcatgagcaagtgaggtgtccatttcctcactttacaacgggttatatgcggattccagcacgttccgttcgttttggatgtttgtcgggtaaggacagttcattgctggactgccctcccctaagaacggtgcataccggtttcccggtacaccgctcaagcctttataagccctttttgagagagccggcttcacaactgtgtaactgtcgatggcaatttggatgtaacaagacaaggttagataattcttcaccgcccccataactttcttcaccttatggtgtacgttccagccagtttcatgggtaatgcgctgccggcatatcggacacaaagagccttgtgactcgagtaggcagcctgacggctgcggtttgtcatggtctgcaattaccgttataaaaacaggcaatgtcattgtctttcaggtggttatatggcccgttcagctaaatcccgtaaacgtaaacccgcctctcaaagaagcaaacttccccgctatgtcgtgaagcttcacgaagatgatttttttgacgaagaagacgcagaagttctgcgctttgattgaaccgccccgggaatcctggagactaggctgtgtcccttaattacgtaagcgttgataaaagagtcggatgcagcccagtttcaccatcgccaggtaatttctcgccgttttgtcgtaacgcgtggcgatgcggcgatattctttcagccgcccaaagcaccgttcaacgacattacggttgcagtacgcatcacgatcaagctgtgcacgtccatccgatgccattttctcatttgactttcgggggattactgcctttataccgttatttttcagctcgttgcgcaatgcgcgccctgaatacgctttatcagccagtaccgcatgtccacggcgtttcatgctgccgttctgacgctgaacgccaatcccgtccagaagtcgttgcgcgaactggctttcatgagcttgtccggggcttagcacgatatttaacgggaggccacttccgtctgttgccagatggattttggtgccaaaaccgccgcgagagcgacccggcccattatctccgtcgatatcgggatgtttttttgagcaccggcggcacatttcagcgcccggatattactgccatccagcgcggtggcagaccagtcaataaagccgtttgcatcaagtagcgaaagcaacctgttgaaaataatattaatcacgcctgactttgaccatcggttaaagcggttataaacagttttccatgccccatatcgttcgggtaaatcgcgccatggtgcactggaacataacacccagaacatgccattgatgattttacggtgctcagcccatgggcgtccggcccgtggtgtggcgggttcaggaggtaacaggggcttgatgattcgagcattttctgcccgcagtgccgataattcatcgctgtcagatttgtgaaccatgccctgctgtaaatctccgcatagattatgtctgtttgatctcagtatcgtaaaaaagcggctctgcaagtcctcctaattggtgacattaccgaccatttttcttccttatgttttgagggtatgtctttaaatatttaaagaagactttagaaaaatacgatggtgaactgtaacctaactcagatgatatgacagaaatgggagtatttgtccttcgtaatttcctgatagcttctgtaagctttattttatgtacaaatgtacttatagaaccgacctctttgtacattcttctttttaaagaagattcactcattaaaaccgcactggccaactcggaattactccagttacgggagtaatttgccatcacaattctggcgattttttcagacacagaaacaaatgatggtgcatgaagaataagcccaacatttttgttttttttcagaatacatgaaagcaaataagaactccgaactttatcgtaaatggcatctgtctccgtctttttattatcagtgcactgatgagcacactgagatattaaccaggacattgcatagggttcatctcccccccgttactttattcgtaccccttataatggggtgttagccagccagacccggcatgattactgcccccagtcgtccatgatccggggggtgatgtcaccgggtctggtggggcgctggtaaccgctaataggggtcaggtcaggcacttttgccgggaccgtctgtaacgtggatgccggtacctgctccccgtggttatctggttaacccatatacaagggagacagaatgaccgaatccagcgattacgaatccgtccaggtctttatcggcgttgatgtcggtaaagatacgcatcacgctgttgccattaatcgttcaggtaaacgcctgttcgataaagcattacccaacgacgaaaacaaactcaggtcgctaatatctgacctgaaacaacatggtcagatactgctggttgttgatcagccagctaccatcggtgcgttacctgtcgccgttgcccgctcagaaggagtccttgtcggatacctccctggactggccatgcgccgcatagccgacttacacgccggtgaagctaaaactgatgctcgtgacgctgccatcattgccgaagctgcccgtaccctgcctcacgcgctacgcacgctgaaactggctgacgagcaaatcgccgaactctccatgctctgcggcttcgatgatgatcttgccgcacagacaacgcaggccagcaaccgtatcctcggccttctgacccagatacatccggcaccggagcgcgttctcggtccgagacttgagcacccggcggtactcgatcttctccagcgatatccctcaccagaaaaactcgcttcgctgggtgagaagaagctggcagcccagctctgcaaacttgcgcctcgtctgggtaaacgccttgcagcagacatagctcaggcactggccgaacaaaccgtcgtcgttcccggcacgaatgccgctgccgtagtactgccacgtctggcactccagctcatcacgctgcgtaagcaaagagacgaggtggcgcttgaggtagaacagcgagttcttgctcaccctctttacccggtcctgaccagtatgcccggagtcggtgtcaggaccgcagccagactcctcaccgaggtcgcctgccgcgccttcgcctctgccgcacatctcgctgcttatgctggccttgcgccggtaactcggcgatccggctcgtcaatacgcggtgagcatccctcgcgacggggtaataaagctctcaaacgggcgttgttcctgtcggccttcgccgcgctcagggatccgctctccagggcttactacacccgcaaaatgagtcagggaaaacgacacaatcaggtgcttatcgccctggcgagacgacgctgcgacgttctgttcgccatgatgcgcgacgggactttttataccccgcaggggtcataacatgcttgacaacttaataggccccccactagaaaaatcaatcaaaacataatcgggagatataagctgagctttggaaattttttttaatcgttcaatgtcatgatcaaataaaacgttatgttcacttatttcctctgacgtaaatcgcacaacacaaatatctcttctttgaagaacagatatatccctgtcaaataaaagagaaaaaggaactaatttattaataaatataccattgtattttgatacataaataacagtattttggacagatatgtggaatggttcgcctgatgtatagataaagtagaaaaacggcagagggatttcaatgtatttaaatattttcgcgtgcgtccctgagtaagggactacaggaggtttattattaataaatatctgttttttcatatcaaagcttgatttttacttatacatctttagaatcaatcagattttgtaaatctgcgccatcatcacacctgatggtatgagaaaagccgctcatcttatcccgttatcaaagcctaagacctatggtgtccagtcacctgacaagcacatcctccatagttttcggtatcattttttctacccaaagtatcaactttcagaaataccgcccatatttaacaacatcaacgaaccgtccaagccgagctgaaatcctcttcctgaaacaactctgtcagcccgctaatctgtttcagcctcagcacttcatcctggtccattcccagctctgtaccaatacgttcattcgtccagcccagacgtgaaagatccctgacaatatcagacattaaagtgatctggtgtttccccctggcccggttatgtcgaatggtcgcggcatacgtgcggcctgtccctttctctccggattaatgcaggctacaggcaaccagcccctcaggcgttttcctgcatctgcttcccgccccagtaactgacgatgaaaaccatccaccaccagataatgattcttctcctctgacaccaccaccggttgtgtgaaaccatctttctccagagactgtttcagtagttttttctcacctagtgccatgacattagggttgtaatcgttggccaccacctcatccgctttcacccacaacacacagtccacaggctcctgtgcaaaaggactgacctcatgaagcactctgcgcagatgattcagagcctgtatgctctctttttcagttcgtacctgactgaaatactgacgaatcatgttgccaagtatctccggtgtcacagagtcccccattccttcctcctttccttcatacgctgcaggtaacgttcatagtgccggggtttgttcggactgaaggagagagtccggcaccagaaatcattctttatgagtgtcttacagatacgtcgccaggacgggtgaggtgtactggcaatagcggacatggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtccccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgagccggtaaacacgtttggcattgatcgcaggcataccatcaagttctgcctgtctgcgaagcagcgcccatacccgacgataaccatacgtgggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggccacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaataatctgttctccaatgactagtctaaaaactagtattaagactatcacttaaataagtgatactggttgtctggagattcagggggccagtctaggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccagactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgtaggagcgaacgtctggttcagcagatttggcgcaactggcagattgtggttcgggttcgtagtcgctctgaacttgcgtttctgcttacagcgtagccttagctccttacgaagacgtgccagtcggtcacgaccaacgatgatgccattctctgccagctccgtctggagccgccgggttccatatgtttcgcgagtgcggatatgtgccaccttaatctccagttttagccgctcatcactttgttttctgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgctttttttaatatatcgcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcagtcttcgggccagcaaaagtcgttcaacaggaagaattctggttctgagtctgctggcaacgttgagcactatcgtaatgtggttactcggttatcacgctgaaaataaagggttacacctgaaatatcaggctaacagcattaaatcccggcgggttatctcatatctgacgttagcgaagaatgttcttcgacactcgccacttattttaagacgaacagtactgagcacagttctaaaccatctgtccagaacctaccgaaatatggtgctggtttattagcagtaattttgtggggatccctcagcccttatagggggcattctgaaaagccacctcctcaggaggtggtcttttactgtgcacagaaaaatccggaaacgagtgagcgtttccggattcttacacagccactggatcggtcaactgatccttaactgatcggcattactccctattgagggagtttaagaaacaatgtttgcacctgagtttttgatggcttaaaaccatgatgaatataaaattgttttgcgttttccgtaagcgcatgaaccataattgcacgcacaccgatattttcggcaaccctgtaacaacgacgaactgcatcatgaagtaaatccgcgccaagcccttttcctcgaaatgacacatctacagccaggcgtgcaagtataattacaggaatggggtctggcatattgcgccgaaggttacctgtagcttctgtatgattgacactaccagtggccagtgagtaaaaaccgactatttgttgcgtaccttttctgcatacaacaaaagtccgggtggctccgattgcctgattttttagctccttctgctttaaccagtcatcaagtacagcttcactgctgacaaattcagcgacctgatgaaatgaggataaaggttctggtgcagttacacatcccattgaggtttccttgccagcaatttttcgatggcaggatcatctgcaaccggagcatcaagcatttcaatgaactcttcatattgcctgtcattaaaattaaacacccgccggtcgagaataacatcttcagcagctttacaggccatttccagaatgaaatctgtacgcgacttatgaagaatttctgcagcagcatcaatgagtatccgctgtgattctcttgctctgagattgagctgaacacctgatttcataaagcctccgtatatcatttgctttacaacaatagcatattgacaatatatagcaaatgatatacacaaagtaacagattacagatgccgcgtcagcggcatttacctctgtggacgtaaccgcactcaaaggggatatcgggtggcgcaggggcaccgcccccctacgctcccacggagccgtacgtgacactctcgcgtcatacggctcttgtcgttgaaccattcaagtatcgtaagctaagcaccagtgtgcaaacagcgtcgggcagtcgtgacgaattcgcagtaaccactcgaatgcacgcaccagactacctcgcgctcgcttgtgtttgcgggcaatccacttggccaagtgcaggtcaacctgcgccattaccgggtatagcttcgattggtaacctcaaacgcctcgactgactgcccatcgacacctgccgcacctcgattagctttgacccgctggtatgctttccaaaccgcatacttagagacctcgaacggctttggctgactcatgggctcctcccggctatccggttgaccgataaaccagccccaacgactgacccccttcgctccatgcccattacaggcacttcctcactactacgaagccatctgcccctgtgtctcgcatcggtactcaggcgcttgcagtgcctctgctccgcgccgctcccttagcatcgagacgacaggttcccacgttccgtacgagagcctgtgttgcgttcatgctgcctatatgccggatgccgcccagccagtaccagatatctgctggactcgtcatgcgctgcgtagatagcacattttcgacatcgcctagaggttcctttcgacacttcatcgacagttcactttcgttcatctccgcaacacctacctgacacatgttctgcgccttttaaccttgacgctcaccaccaccgctcttaacggcagcagctcaaggcggtttgaaggctgcgtctggacgccgcccctcatctctcatacagcattgcatccaacatcacgccactggatgcattcgtggcacacctacgccggaaacgccgaaattcccggcctgtgatttttagtggtccttcggtacttcagtaactccatcagctatcccctgagcaagtcgttccatccatttcgcaaatcgaaaatacccggggtattgcagacaaatataatccatctgaacttttgaggtgctgtccatcacccgtttaaagtaaccggctcatttaaaccgtctggtctgttacctccggttccacaaaaataatgtccatcattttgaaggtaagcgccccgagaagtacgtagcgtaaggattattttacagacgagaagttccagggcagcagttcatgcacttggttcgacggccagtcattgagcttctcgatcacttcgcgcaaccagtcctccggctccacttcgttctgtttgcaggtgaccagcagactgtagatgatcgccgcactttctcctcccttgtctgagccgaaaaagagataattttttcttccaaccgccaccgatcgtaacgcgttttcaccgatgttgttgtctatttccacccggccgtcacgacagaactcgttcagcgcattccagtgattcaggatatagtcgaacgccttcgccatctccgcatgtttcgacagcgttttcctctgcaactgtatccagtcgtacaacgactgcatcaactggacgcttctggcttttctgactgcaagccgttcctctgccggactgccacgtatctccgcttctatgtcgtataactctgctatccgtctgagcgcttcctgagtcatttctgtcggacggcgcacatcctcgtcatggatttttcggcgggcgtgggccaggcacccggcttccttcacccggcccgtttcgtacagtacgttataacctgcataggcatcagcgggcagtacgccctgatactttgccaggtggagctgcggatgttctcctttgcgatctgccgaatacgcgaaccagacggctgccggcagggatgaacccgcattacgatcatccctgacgtatacccacagacgacccgttttcgtctttccgttccccggggccagtactttcaccggagtgtcatctgcgtgcacctttcctgcctccagaacatagtcattcagcgctatatacagaggacggagtttgtctgccatttctgatacccagcgcaccatggtattacggctcagctccacgccctgtcgcgcgtatatttctgactggcgatataaagggatatgttccatatatttgctgaccaggatccgtgcaagtaaccctgcactggcataaccgcgttcgatcggtttaggaggaagtggtgcctgaacgatgacatcacaccggctacaggccagtttgggacgtatggtttcgataactttaaaggcggtattaatgatatccagttgctctgagattgtttcccccatttctttcagaacacctccacaggccgggcaactggtttcagcaggcagaaggcgatgtgtctcccggggaagttctgccggcagcggttttcgtgaagattttcgtcccgggaattcaggcttactggcgatcgggttttctgacgggggactggtgtcaggtgaatctgtgactgacgatgcatcttccagaagatttctggctgtgttcagccggttttccagttccgacagtcgtttttctgcctgtcggatctgattttcaagcttatgacgctttttctctgaactctggccgaacaacatacgacgcaacctgtcgagttgcgctttcagccgttcaatttcctgctcatagcccgcgacctgacaggcatactgtcgaagccgactctgttgcttacgcaacatggctttaagcagctcaatatcatcggggagttcattgttcattcccttgttttatcacgggttatatccggatgccaggccgttctgtccgtttgggatgttgccacgcgatcccctccagtagcatggataactgagctggcgtcaggtgcactttcccttcccgggtcaccggccagacgtttggcgaacaggcataacccgtcacgatcggcccacagtattttcaccattttgccactgcggccccggaagacgaagatatgcccggagaacgggtcatctttcagcgtgttctgcaccttcgaagccaggccattgaagccacaacgcatatctgtgatgccagcgatgatccagattttggtaccggtcggcagcgttatcatcggataccccctttcatttcgcggattagcgcccgtaacagttccggagtgagagggtcaaacagttttaccacacctgatttaagatgcagctcgcaccgtgggacgtttccgggagccccctcagggcgctcatcatgcttgttacgccagaagggatttgtaactggtctggtcggctccggcgtatcagtcagtgccaccgggacaggcatgcattcctgtatgtcatcatcgctcagtaagccgtcctcgtactggcttttccatttaaccagcaggttattattgatatcgtgttctctggcgatccgggcaacaacagccccaggctgtaatgcctgcttagccagacggaccttaaattcacggctatagctggttcgccgttcttttcgccatgagccttctctgatttgaggctctgttaattccttctttctgttggcataaaggatggcgtcaagttgagcgaatgaaactgaatcgggcaatggccatgcgataccggatgcaagaaatcgctgaaaaagcgtatgtattgtggaatgactgagacccagacgctgagcgatggcccggatggtcagtttatcttcaaatcttaaacgcagggcatcaggcaaataagaacggaagcagggaatatcttttgttgtctgggaattcatcgttcgtgtccatcaatatagatgggcgcgattgttgccagacaggacaattttcacaagacgtcgctgatggggcgcttacattaatcccgtactctctggccagttgggccacgcaggcccctagctggtaagatttttcaataagatcaagcttaaactccatagagtcatagagtaagaggcacgaatcctgcgggggcgaagagaatctgacattgatagagtccattaacgttataagaggactctatcatcgccaatcatcagacattgaaatagacgacactgagatgacgcttacaattcttttggtttctgtaataagtaatctgacatcccccgtgcccagaagaggagagggatatcaagcccaagggttaataattgatactacggttaaaattgccttcagtaaaggaagtgtgattaaactcaggggatttcagagtgaaaatcgtacaacatattaaaatatgttcgttataatacatacaagaaaatattaagttagataatattattctaaataactgcagataaaaacgcacataatgggggatgttttatgaaaatacctgaagcagtaaatcatattaatgttcagaacaatattgatcttgttgatggaaaaataaatccgaacaaagatacaaaagcattacaaaaaaacatatcatgcgtaacaaactcatcctcttctggcataagtgaaaaacatttagatcactgtgctgatactgtgaaaagctttttaaggaagtctatagcagcgcaaagttatagtaaaatgttctctcaagggaccagtttcaaatcattaaatctttctattgaagcgccatctggagcacggtcatcatttcggtcacttgagcacctcgataaggtgtccagacactatctttctgaaataatacaaaaaactcatcctctttcttcggatgaacgtcacttgctctctattattattaattctgattttaacttcagacatcaaagtaacgctaacctgtcaaataatactcttaatattaagtcctttgataaaattaagtctgagaatatacaaacatataaaaacacattctctgaggatattgaagaaatagctaaccacgattttgttttttttggggttgaaatttccaatcatcaagaaacactcccactaaataaaacacatcatactgtggattttggtgctaatgcgtatatcattgatcatgactctccatatggatatatgacattaaccgaccactttgataatgctattccacctgttttttaccatgagcaccaatcatttttcttagataactttaaagaggttgtggatgaagttagcaggtatgtgcatggtaatcagggaaaaactgatgtgccaatatttaatactaaagatatgaggcttggaattgggttgcatcttattgattttataagaaagagtaaagatcaaagattccgagagttttgttataataaaaacattgatcctgttagtctggatagaattataaactttgtgtttcagcttgagtatcatataccaagaatgctaagtacagataacttcaaaaaaataaaactcagagacatatctttggaggatgcgattaaagcatctaattatgaagagattaacaataaagtgactgataaaaaaatggctcatcaggcccttgcttattctttaggcaataaaaaagctgatatagcactttatttactatctaaatttaattttacaaaacaagatgtcgcagagatggagaaaatgaaaaacaatagatattgtaatctgtatgatgttgaatacttacttagtaaagatggtgccaactataaagtgctagaatattttatcaataatggattggttgatgtaaacaaaaaatttcaaaaagtaaatagtggggacactatgcttgacaatgcaatgaaaagcaaagattcaaaaatgattgattttttattaaaaaatggagcaatattaggcaaacgatttgagatatgacctaaaagctcggccaaataataatgtcgtcgattatcgaagtcatcatgagtgattctgtccccacagtgcagcatcagcatgacagtgaattgtctggcgtggtccatttaatgagatggagatggtccctctttcctaaatagctgtgcctaataccgctacacttttgccagcccatgtttgcctccggggaatgggctgacggttccttcaaaatccattgcacgcagttatgtcggagcgggaacttgactcctgtctttacgggagtgaggtagcctgagtttaacggacactccttcctgaaatagaatggcatcagaaggagccaataatgagcagaaaaacccaacgttactctacggagtttaaagccgaagccgtcaaaacggttcctgaaaatcagctttcgatcagtgaaggcgcttcccgattatctgttcctgaaggcactttaggacaatgggttaccgccgcaagaaaagggctcaatacaccaggctcccgcacagtggctgagctggaatctgaagttatgcaactgcgtaaggctttaaatgaagcacgacttgagcgagatatattaaaaaaagcaacagcgtattttgcacaggagtcgctgaaaaatacgcgttagtcgaacaatggcgacaacaattccctgttgaagcgatgtgtcgggtacctggtgtatatccgcactcgcgaaacatatggaacccggcggctccagacggagctggcagataacggaattatcgtcggtcgtgacagactggcacgtcttcgtaaggagctgaggctgcactgtaagcagaaacgcaagttcagggcgaccacaaactctgaccacaatctgccggttacgccgaatctgctgaatcagaactttacgcccacagcacctaatcaggtctgggtcgcagatataacgtatgttgccacccgggaaggatggctgtatctcgccggcgtcaaagatgtttatacgtgcgaaattgtcggttacgccatgggagagcgcatgatgaaagagttgacgggtaaagccctgtttatggcgctcaggagccagcgcctacctgccgggctaatccaccacaccgatcgaggttcacagtactgcgcatacgattacagggtcatacaggagcagtctggtctgaaaacatcaatgtcgcgtaaaggtaactgttacgacaacgctccgatggaaagcttctggggaacgctgaaaaatgaaagcctgagccactatcgttttaagagccgggatgaggccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgccagtacacctcagttctgggccttgcccgtagcagttatttttatcaccgggctgcactgaaagccggtgataaatacgccacgatacgtaagatgctgacagatatctttaacagtaattaccagtgttatggctatcgtcgcctgcatgcgatgctcaggcatgagggggggcggctatcagaaaaggttgtacgcagacttatggtggaggaacagcttgtcgtcagtcgtaaccgtcgtcgtcgctacagctcatattgcggagaaatcggaccggctccggataaccttatcgccagagattttaaggcggagcaacctaatcagaaatagctgacagatatcacggagttccagctccctgcaggtaaagtctggctgtcaccagtggtggactgcttcgatggaaaagttgtgagctggtctctcagtacacgccctgatgctgaactggtcaacactatgctggatagcgctgtcgaaacgttaaatgctggcgaacgaccggtgatacacagtgacagaggtgggcattatcgctggccaggctggctggaaagagtgaatgcagcaggtcttattcgctcaatgtcccgtaaaggatgttcacctgataatgctgcatgcgaaggctttttcggcagactgaaaacggaaatgtattatgggcgtaaatggtcgggcatcacgccagaaaagttcatgcagcaagtggatgcttacatcagatggtataacgagcggcgtataaaattatcgctgggtgccgtcagccccaaaatgtaccgccaacaatgcgggctggaatgataaagcagtccaggaaatcgtccgcatccccccttcaccatttggattgtccgctccacccaacatgttgtttccttaaggttcctacaccacaaaggaaactctcatgctgcgcagtggatggctgacgttgccgacaggcgggaacttcgccagttcaggcagacaccggaacagcgcttcacgcaggaacaggagcatctgcagccgctgctgggtacggacttcgatatccgtcatgtctcctgggatggctatatcgaggttggcgggaaccgttacagtgtgccggaaagcctgtgtggtcagctggtatcaatacggatctcgctggatgatgaactgcggatctacagtaatgagcaacaggtagcatcgcaccgtctctgttcggctgcatacggctggcagaccgtgccggagcatcacgctccactctggcagcaggcttcggagcgcatggccgaatggctgggggagatacagaaacgggtaatcactgtctgtgaccgggaagcggatatctggcattacctgtattataaagtcagccacggacagcgtggtgcgtgctgcacagaatcgccggctggaagaggcacccggcaagctcttcgaactgccggaagtcctggcaaccgcaggaagccacacgctgaatgtgatgcaaaaaggcgggcgggcagcccgtcaggcccggatgttcatcagttacagcgaagtcagcataaaaaatcccgacaacagcggccaggcgctcccgctcacgtatgtctgttgccgggagcaggcagaggacggtgcctgctggcatctgctgacgtcaggaaaagcggcgagtgccgccgatgcacgacgtattgtcagccattacgagcgacgctggctgacagaggaataccacaaggcgtggaaaagtggtggtacatggaatcgctgcgaatgcagacccgggataaccttgagcgcatggtggttatcctggcgtttatagcggtacgggtgctgggcctgcggcagggaggtgtcagtgaagaaacacaaaatgacagctgtgagaaaatactgacgccgacagagtggaaactactgtgggttaagctggaaggaaagccgcttccggtgcaggcaccgaccctgaaatgggcctggggcgatggcatgacagcaaacgcacaggtcgtcccggttggggcgtcatgtgggatggctggtcagacttcaggatatggttgagggttacctggtgatgaagtctcttgatcaggagctctgatcaagagacagcagcttaggggggtgcccctattaagttgtcaagcatgttatgacccctgcggggtataaaaagtcccgtcgcgcatcatggcgaacagaacgtcgcagcgtcgtctcgccagggcgataagcgcctgattgtgtcgttttccctgactcattttgcgggtgtagtaagccctggagagcggatccctgagcgcggtgaaggccgacaggaacaacgcccgtttgagagctttattaccccgtcgcgagggatgctcaccgcgtattgacgagccggatcgccgagttaccggcgcaaggccagcataagcagcgagatgtgcggcagaggcgaaggcgcggcaggcgacctcggtgaggagtctggctgcggtcctgacaccgactccgggcatactggtcaggaccgggtaaagagggtgagcaagaactcgctgttctacctcaagcgccacctcgtctctttgcttacgcagcgtgatgagctggagtgccagacgtggcagtactacggcagcggcattcgtgccgggaacgacgacggtttgttcggccagtgcctgagctatgtctgctgcaaggcgtttacccagacgaggcgcaagtttgcagagctgggctgccagcttcttctcacccagcgaagcgagtttttctggtgagggatatcgctggagaagatcgagtaccgccgggtgctcaagtctcggaccgagaacgcgctccggtgccggatgtatctgggtcagaaggccgcggatacggttgctggcctgcgttgtctgtgcggcaagatcatcatcgaagccgcagagcatggagagttcggcgatttgctcgtcagccagtttcagcgtgcgtagcgcgtgaggcagggtacgggcagcttcggcaatgatggcagcgttacgagcatcagttttagcttcaccggcgtgtaagtcggctatgcggcgcatggccagtccagggaggtatccgacaaggactccttctgagcgggcaacggcgacaggtaacgcaccgatggtagctggctgatcaacaaccagcagtatctgaccatgttgtttcaggtcagatattagcgacctgagtttgttttcgtcgttgggtaatgctttatcgaacaggcgtttacctgaacgattaatggcaacagcgtgatgcgtatctttaccgacatcaacgccgataaagaccaggacggattcgtaatcgctggattcggtcattctgtctcccttgtatatgggttaaccagataaccacggagagcaggtaccggcatccacgttacagacggtcccggcaaaagtgcctgacctgacccctattagcggttaccagcgccccaccagacccggtgacatcaccccccggatcatggacgactgggggcagtaatcatgccgggtctggctggctaacaccccattataaggggtacgaataaagtaacggggttgtcgaagctcaccagattttcaccaggatgcacgtcatactcttttttctccggaggcagtgccagcatggactgctgctcttcgagccagcgatcacagggacgggcctggattgtttcatgctttcgttggttagcgacatcgtgcagccagcgcagaccgtggcggttggctgtttcaacatcgacagtgctccccatcgggcgcaggcgagtcattagtgggatgtaaaaactgttacgggtgtactgcaccatccgttccaccttacctttagtctgtgccctgaaggggcgacacagtcggggagagaagcccatctccttgccgaactgccacagcgaaggatggaaccggtgctgaccggtctgatatgcgtcacgttgcagaaccacagttttcatattgtcatacaacacttcgcgcggcacaccaccaaagaagcggaacgcattacgatggcaggtctccagcgtgtcataacgcatattgtcagtgaattcgatgtacaacattcggctgtatccgggaacagcaacgaacacgtgaagcggtgagcgaccattacgcatagtgccccagtcaacctgcatctgtcgtccgggttcagtttcgaaccgaacggcaggctcctgctcctgaggaaccgagagagaacgaatgaatgccctgagaatggtcattccgccacgatatccctggtctctgatctcgcgagcgattaccgttgccgggattttgtaaggatgagcatcggcgatgcgttgacgaatataatcccggtattcatccaggagtgaagcaacagcaggtcgcggcgtatattttggcggctcagattttgcctgcaaataacgtttaacggtattgcgggagagccccagttctctggcaatcgtccggctactcattccctgcttgtgcaggattttaatttccataactgtctcaaaagtgaccataagctctcctgaatcaggagagcagattaccccctggatctgatttcaggcgttgggtgtggatcactattgcaccgttcgtgacacttgttgactacctgtgcggcatctggtatcaaggtggcgtgaagccggttcaggttctcatgcggaacgttggaacctatatccccccgataccaaaggcgaaatgtaagtgacaaaatgcaatgaacacgttctccgttaactgaggagcatggtgataaataaaggtaaatgcagaaggtgtagagtctcgcagatttctgacatcatagagcctaacattagatgcataacgctacagattgtagaatctctacaggtgaaatatacactggttggcgtttatgtcgcaaaacatgtcattcaggttcatctcaccaataaggatatgagtgaagtggaggataagtgagtctgctgtcagagttttctggtgtatgtcagtaactgcgaaccatgtctgcttgatatgggagcttatggaggctctctgtacaaggttagggagctaacaaagcagggataaaaagtccgcctgatgcaggcacggttcgttaaatcttttgccattggtaacaaaatggtgcgatgaatgttcaggctatctttatcttgatggtggttcagctgtttggtaaagaaatcgctgtaacaatagaagaactgcaggcagtactggtcccacatcgtttgctcagtcaactggtgaagttccgtagcgcgtaaattaatgctttgcatgaaacgttactggagtggatgaaagaatacctgcatatatcattactgcgttggattaccagtacaacagattgaatgaactggacatgttgatagacggcattgaaaagcagcttataagcatagtgcggcagagttaattggagagcacttcgccttctgagtattaagtaagcatggtggtacctgcggatactatctattcactgtgctcggtcggcagccttactgaccaaggagttgggggagttgataacaaagttgaaaaaacagctctcaaccaaggtggttattgtaacaatagcaaataagctggtgtgacctgtatcacaataaccgattatggacgtaaatacgacaaaaatatgtcagtatcaggcggtattaattgctgatgctgatggacattaactcttaataaaagggtggatgctgaaaggttgttatggtgacggacgtgatgacgacggaaaagagtatgaggttttggatttaaagttcgttcggggaataaggacccggtcagctaattctcatagtagttcgcattgctggatgcaatactgtgctgcaattactcgtcgatgtcggaacaacggaagccttgcaaacggggatgtattcatacaggtgttatgttatatggggttttattgcagggggctataccaagagaatatatgatatctcatcagactgatgtgagggtaaatgagaatagagtaaacgaacaaggttgttttttggcgaggaagcagatgtatgacaattcttgtggagctgccagtttactctgtgctgcaaaggaattaggggttgataaaataccacaatacaaagggtctatgtccgaaatgacaaggaagagttctcttgatttggataatcgttgtgagcgggatttatacttaataactagtggtaattataatccgagaatacacaaagataatatcgcggatgccggttattctatgcctgataagatagtcatggctacgaggcttcttggattgaatgcttatgtcgttgaagaaagtaacattttttcgcaagtaattagttttatttatcccgatgcaagggacttattaattggcatgggatgtaatatagtacatcaacgagatgtgttatcttctaaccaaagagttttggaagctgttgctgtatcctttattggagttcctgtcggcctccactgggtgttgtgtagacctgatggaagctatatggatccagctgtaggagaaaattattcttgtttttcaactatggaattaggtgcaagaagaagtaattctaactttataggatatactaaaataggtatttccatagttataactaatgaggctttgtaaattgtcgttttttatctgtgaaggagcttgaatattttggggtggggggcataacaaatgatattactgagtacaaatttagctatattgggcggattagttgtgtgggaagacgaaatgtttctcttgaaataagtgagctccctcaaggaatgattgtgtgcttaaatatttaagtgctggtaagtttgagaaggctgacatattttgcagagcaaacagtgattgacttggatgatatttttattttagtcactcgttgtaattggagtatgctttattttatttgaaaatagatgtattttatacccgcaatttaaactgtaagccctatgaggggtatggatattataagttactctttgaccaagcataacttttggggttagaaaaataaatctcttgttaataattaatatgattttaaaatcaaacttgtttataattataaaataatgtaagtcggtcattttatgggaagattaggagaataaaacagtaattatatttgagaaatctgctaatatattcttaaagcttttttgatactgtgaacgaagtctgttaatggtggattttttgtttatcaccatgtaaaaaaaattgagtagtaaaagcgttgactgctaatcctcgctgtttttattgaaacgattaaaaatacgctgaatattttcggccagtcactcatattcacataaaattttgaccatcatgccgcatcccttagttgcacaattcattttcaatgatatgaatattactaatttcaccagataattttctcgtggtcagcagggtatgagttttcaccgtaattttaaggaaacacagtgcgtggggattgaataacagatagccgacggaattaccccaccggctgaaagtcaagttcaacgaagatttttattatctgaattgggcagtttacatcagtgttcgatgtttatgaagacgatagatggcgagaaattatatcccgaatagcttcatctatttctctctgaactgttttgtttattttagataatgtaaatattagagttctgtttgttttattctcttttctttttatgtaagtccgtttgtctttagaaataaataacgagtcaacttttagcgaagggttttgctttctgtttttgcttttctttatgatgtttaaaatttcttttttatatatgtccgggggcaaatttgtatcaaggtcttttatttcttcctttaatattggtagtgtagaactaagagattcattagccttttcaagtcctttataataattgaataatatcttgtagtcattaaagttaagttctgacgcgattggaaatagagatattatttcctgtggaacgcttgctgcctgaaaggcacgagtgactttcgcgcgagacagattctcttttttggctatgtctttataggacatccctgatactttcagaaaattaagaccaataccaagttctcggatgctatgctcttttgctgtttgtatatcgtttgctagttttctggcatcaagagtagatatatattcttttgaatatagaacttcaagatctgctcctgcatatattgcagatgctcttctacgagtgccatccagaatttcaattctaccatcaatctcccttcctattacagggaagaattgttgtagctttatagtttttatgatatcggctaatgattcttctgttagggattcttgatcgcgtacattcgttttttggttgacgaaggttaaatcttggatccttttatgaggaatcttggctttgataaaggaaactttattaccagaatggagtgtaaactctttcttttggccttcctttatacttaacaagtcgttgcacaaatccaccatatcacaccctgtttattcatattgatttatattgacaaaagttaaatgcagtgtgagcaagattgtatgtaactgttgatgatagtcaacggtagtcttaaaaattactattttaatagctggattgatgcaatttatctttattggataaaagaataatattcttgtggagctctgatgtgagagctccatagatgaaaaaatgcttatcaattactatattgattttgtactatttttgactacagaaataagatctccaatagtaataatgtgttctaatgtagattcatctatacgtagattgaactcaaaactaatcatatccagcatttcaatcagagaaagagaatcggcagaaagatcttcaataaatttagtttcttcagatagtttgctgtacgctataccatagcaaaaggccactattgataatattttttcttttatcatattttaatccttattgatattctttaatacttttgatagggaagtggttacatcttttgctgctttatatatattattgttttcagctgtaatatcattgttattttttaaatcagatatatcatctgtaagtaattctgcagaggtatcgtcaatttttgacaataccttgctgagggcgctagatacttcttttgccttttcatagatcgcatgatttttatcaattgtatctgcgttggtttctgttacgtagtttcttatatttgcatctgtaacttttaatttgttgtttattctatgttctgttgtggattttgtaatgtcctttgatttttcctgtaactctcgttcttgtgttcctgatttagttccaatgagagatataagattacttagggagtttgttactttttttgaagcttcaaatatcgtttcccgtgttaaatatgtgtctccatttcttgataaaaaatcagtctgaagtacttttgaatcagtgtttgagttgaatttattgatttgcgaagctactctatgagaaagagaagcgctacttttagttgtatctgatgagttatcattactgcttgtcactccttccgggtggagagggggggtggttgaagagttctgtatgttcagaggcctgtgtccccgagaaagagagttatttgcagatctttcttgactactcgtagttaacaggtctgaacctattccatccgaattatctggagtatggttgaaagccttttctaaagctgaattatttgcaaatgtctggacagtatctgatatagagtgtggtagaacggaagttactttttgaactagtgctctttgtggatttagtaatgagtttccgttacgggataatagatcgtttgtctgagaagtaggagactgtgcatcattttctgggttctcgtgatagctattgtcatatactctgttgtcaaaaactctattatcgtaagttctattatcattatttatatgatagtgaattacaggttgggatgttttctcattggctccgggggttggtccgccatctggcatatcttcgggaggtgtagggaggccatcttggataggatgcgaatcttttatatcttctaaaatatcattaaggacttttctcaacagctcaggaaacacggctactgtatttaagtctcttgacagtttacctataccaaatcctttactatcaatagtatttttacgttgattgcgcaaactatcaaaggcaagttttgcctgtgcgtcaactaaatcatctagtttgagagatgaaacagtttcattacttaactttaattcagcaagaatattattcttgataaatgatgatacttcagtattgaggagtttttgtcccaatgataaagcttcaccagatgtgtgttgttgtgctaatagtgcaagtctgtgctcaatgttttgtcgtaattgatggagtttcttattctttgccgaccatggtccaaaggcagaatcttgggataatttatcttttataattagttccgaatactgtgcgacaattttttgaagtcccttttcgttttcaaaattaagaccattttgatgtactaaggagtacaaaacatttgaaaattcgagaatctcgcttttggcatacgcattcattgagttggaataaatgcttcttaacacatcttctttccctgaggaagaaaataaaaaatcaagacatttctgattaaaagacgttgcaaagttttctttttcagacactgatgctggtgtttttagagaagtttgcgaactatggatatcggatattttgctttttaactcgctgtattctgttgatgatggtgaagttgccttatataagaatgttggcgcttgagtattatttacattatgcatggcgcacctcagaaatggagaaaaagtttatctgtatctgtacatgagcttattgtactactcaaaacctttactaaattatcaaaaatactattggcattactgtatttttgaactaaagtttgaagattatttttcattgtttcatcttcggcagagaatccggcattccatgcctgatattttgcattatctagcacaacctcgccatttccacctagattatctaagctttttaacatattgtctattggggtcatgtttatactgacaacatatcccccgtttttttgagataccttgccgattgttccacctaattctgtaagccatttatttgcttgttcctgactaacagtattatttgctggatatagcggtttatctttatatttttccttgagttcttccaatgcctttttaagcgagttgacttgtaatttcacggagtttccgtcgttacctccgggagagatccagccggcaagactggaaagaacagcgctaaaatcttgatacatttgagtatatgaactaacggcatgttcatatactttcagatactgttcattaatatcattgatggagtttgcaattttagcccacagttctctatgagatatcatttgatctccatcaagctcggcttctttcggagctgaatgtaataattctcttgcgtctttattaattggatattcgtgcctggaaagaatatccaatagttgagcggatttatttacatccatgctaatctgagatgaatgtaatgctatttcttctagcgatgttttagtcaacgttttttgtgaaagctctttctttaatgcctgatttgttgttctgatattatgaagggtgtcgttgagcatagtaagggaacttacaggatgagaactggtcgttgtttttatatcagaattaactgtttcggttgatgaaccgttggtattgtttggactgaatgatgaggtggaaatactattagtcagagttgttatattcatggttatttccttacaggaagagccatatattattatggctcttggatatattaagctcgaatgttaccagcaatctgactggctgtcgaattctttgattggttgatgctgtcaattatattcaataatttttgtattaattgatttgtcgcttgggatgcttctttagatacttgggatgcttcctctgcttgtttactgctggcctgactgattagttgttcttcttcttcaagagcagatgcataacgccctcctgatgtggatatattaccagcaacggctgatgtttccattgttgcacggccaatgttttgtttttgctgcgcagaaagggtattgagctcgtaagttcttctctgggtgtcaattttatcctgcaaagaaatatcgggagaactaagagaagttttatgttcagttgacagggatatattatctggcgccagtttatttttacctaaaaattttgtgctagagttagtttgtggtgaggtgatatttgtatctatttgtttatttaaccctaatttagaacctgcaagctctttttcaagagattgagcagtggcaaggttctttcttaaggctcctttttggtcgctaatccctgaatgcgtttttttggcaccgatacccgttatacctacttgtgtgactgctccagtaatgcttgatgatagggctgccaggccttgccgaacaatgttctctgcagctgattttgtagcatcgaacgcaatcaatgacaattgagagcccaatttagtttctgcagtgcggagagcagaaagtagaacggctacactaataattaaagaaacagcattagaagaaagactggaaatatccagagtgttctctggagtaagggtgtgactcatctctgaacgatctttcatctttttgtcagtaaggcgagcaatgatttctgaatcatgctgaacctgctctgataactttaaaagttgatcatcatttaatgtggttgttaatacgggatttttaccgacattaagtggaatatgcgctgcaatctgctgataattttgtgatttttgtgtttcggaagaactttgagtttgttttgtggatatatctgtatataaaatctgggttggttttgtgttttgaatttccataacattctccttatttgtatcaagcagtagtttgttgcaaaattgcttttgcaacatcagttctattagcctgagagttggacattgaggctaatagatctgcaattacttcctgcaattggccgaatttttctattgcttcactgatatattttgacagttgttcaacttgatatttcgataatgtcaggtctgctagatttgtcgacgcgctgttctggaaaacagcagaagcgacacttcctcccgcttgtgtggcagagttaacactttctcctaataaaactgcttggtttaaatgggtggaaataatttgtttggatattacttcatcacccgctgcaccaagaaatttatttaatctggcaacagcattagtgattaaatcgtccagttgagaagaaaaattcttgagaaactttggtataaggtctgtgagggttttacctattattttgccaatattttctgcaagttttgctgctgcctgtttaccaacagtggctacgagaacgactgctgcaactaggacaagagcgcctgcgattgcccccagaatagagccaatcattttggcttttttcgagtcgacgcccaagccttcgagcatttttgtaaatgcatctgaaaggagtttgattaagggttcaatgactgctttcatgatcggattcagggcttgttccatgaaggaattgccggtcgctgcttgtactatagcatccgtaaccataagagctaaaccaacagctgccagtgctagagaggctcctccagaaaaagctgctgcaacaacactaacgatagttaaaagtgccccaagtattttcccaacacaacccattactctgttgagttcttctgctttacgtacttcagcagcatactcatcagattttctctccatttcagtttttcttgattcttggagagactggaatagagccagatcattttttaaagattcttcattattttttccaactagttgaataaaggttgccatcaattgagtaacactggcaagtccggttaatgatttctgctgggttgatagctgttcagcagatgctgtgtttgaaaatgcagaaaaagagtctatttctttttcgagttgcattgatttatctgtaagtttgctatgaattgacagggttttctgctcaatcaatgtcctgtctttaactgctgcgtcttttttgatagtgagttgtatttcttcccggcttaattttttcttttctggtgactctgggtcgagttcggataatcttgtttgaatttggttaattttattttctaggtcttttattttagaatctgcgttttttagtttattaatttgtttttcatagtctctggttagtccttcagtttcagatagaagagtgttaattttatcggagaattctaggtttttttgctgtcttgcctgttgctgggacttccaagcagtaattttatttgttaatgcagttaaagatttttcaccgagtatttgaataaggtttccaattaaaagcgttagttgggaacttgcatttaatgactttggtgctttaagttcagggattaatatatttgaagttgagtgtgcattagttgtattaatattttggttagcagtaagatcagcaattgtaagagaaaataatttgttagctgcatcatttgcagcttggatagtattgtctccaagctcagtggaagccaatattttggcaagaggaaaaccagtggttgtggtgcttacattatgcataataattactccttgatatcctgaattgcgtccaagtatgattgtgcttttatttttaatttttcatcattgctgtgttgaattacgagttcgaagcactctttagcttttaagggggctttcaaccgaagctggcattgtccagtatggaatactggtgtatagtcattttttcctaatgcaaaagcgacagcataaaggtctgctgcttgttggaactgttcttttatctgataaatagctgcgagtcccataatgtagtctacattgtaaaagtcgtatatacataaaaacctgaagaaaacttcagcttcctctattcttcctttgttgtaaaagtcataagcatatgaataaatgtcatccatcatatcatcaggaattgcattaatatctttcagtgtagcgccagagttaattgcatcaattactgcagtagagatgctttcattttcggtgatatttaaagacataaggtctcctttttgtctgctttactttaataagtataagatttaatataaaagatttaatttgtattgctttgacggtatacagcctttagaacctctgcgcttatttctatttgtaaaacttttgttgattcattaaatattttatcgtagacggaactggatactagatttgtaagatccttcatttgtgtgttaaacaaatccatgtcactgctatagcgttttaaaatctttgctctgaggccagatgaggcaatctcgtttagtgctgtatgactgatagatgtttgtgctgatttttcatcaagttttatatccgggaattttttttcaatagctgcaaatatgtttcttttgttatctgaggtcaaaacaactccattgtgtatggccatctcatctatacttctgtttatcattgaagagacataagtggttcgctcttggctcatccaacaaaatagttgattccccgaattactatcttttattttgtctatgacgctgtccctgattttatttatattcaccgggcatccaaaattcttctgaggaaagcgttgttttaagttaaaaacagataatattttctttacaagcttattgcgacttaacgaatcaaatgatgggcgaggaatcgcgaattcaacctgtggaagtattttgtttagaatttgcatgataccccctatatgttagttcacttctgaagtgatgtttgcaatggttagtttaatacaaaataaaaattcatacaaagattcaatgagttcatcaggtgaaagatattttttgtagtgtttcttggtcaaaacacattgatgagtatcagggagaagacagatagaagaaccataatctctactcaaagagtagttaaggatgagtatgtgttctggattaataatattttctgtaaaaagttcatgttcattaagaagtccggtcaaaaagatgtattcatcattatctgttatacaaacaggtatttgttcttcgagcaatataaaggcttgatttttatcgttaaaatcaagctttgcacctgttatttcataaagtttatcatatagtttgcgacacatttctatggccttctatatattagaatgagagttattcaataaaagcttattgatctgtaataagtcgtgaatgtaaagtttggttccaagatctggcgatttaagagaattgtaataatcaataatttttattgatttttcgatgatttcttcttttttatctgttgcttcggtttttaattcgtttaatacacgagtcatattgctgggtgctgattttactaagtatgagtggcaagcgttgatgaccgcatcaaagtcttctgaagatacattttcagtaggatgtttgtaaagtgaaattgataaaggcttgaatgtttttggtgtgtggataaggttaattttattgaaacttttaagatagctgcgtcgtaattgagtcaatctggaaagatcaaaatcagattcaatatacttcattatttcgttataagactgattgagactttcaatgcgttgcctaactttatttgcatacgcgtatacatcgttaggtgtagcaaccaatttaacgtcagggagtggaaagtatatttcagaatttcctgctttaagaacattaagtgccataccagcacagttttcagatttactgattaatttataatttgccaattgtctgaaagcatctgctttctttttgcatataaattttgacatgtttgtttcatcaaggccaaaaaggttatggctgattttaccatcctttgttttattatcacctgataatggaatgtatactttatcagcactgaccccccaataaccataggggtcttttttttgattagctctgggaaaaaatatttttttgttgttattttgatcttgttttgaatttaataagtttctaacctcttggcctgcatcaagtctttcggctgtttggtctgaaatcatatttagtttgtcttgcttataggtatcgacactgtaacctgagcgtttttcaaaaaggtagtttatttctgtatcttttgtaacattcccgccgggataccagctgagataggtatgagttggttcctgtagtaaattgttttttatactgatactagtatgccctaaatgggttatgcctctatttccccagcaacgaaaaactaaatgtctttcaagatttttggctgtaccgatgccatgaaaacgctctgcggtattcaacattaatttgatgtctctacctgtgaaagagtgttgaattgagtttttagctgcttcataggcggcaaacgcactttctgcagatttttcgctagctaatgtattgaggaaaagcaataaggatttttgattctctagtcgataattttttagttgttcatttaatatctgtgaatttatctttgcattaatagtgcttaatgttctgaaaaagagatcctttaggttgaatttctgtgctatcaatataggtccatgctctgtatcttcaacgcgtataggcccttttgtattgcttgcgtcaatgaaattgctaattttgaggatcatactttattaactctccattacttggtgattgtggggatgtaaaatgtatttggtatataatatattcaattaataaatttagaaacttgagcctgttaacataatcaaattttcttttgctgtacataatatgtacctcgtgagcatatgtagtgctcgtttcatcatgaaatcccacaagataaagtgcctgatgtatcaggctcggagtgttatagaaaaagagagaaccctgttgaataagtatcttttttgttgtaaaacgaggtacaaaactgcaatcaatgccccatttatgactgaggataattaaatgcacataactaatttgggattgcatcaggtttcatttcaaagcggagattcctataaaggcgcagaagaaaccggaaagcacaaaggtgtaagcgtgatttcatatcaaagagttaaaaatggagaaagaaataaggggatcgaagcgcttaatcgattatatttacagaaccaaacaagcttaacaggaaaaagccttttgtttgcgcgtgacagagctgaagttttttgcgaggcaataaagttggcaggtggtgatacgtcaaaaattaaagccatgatggaacgattagatacctataaacttggtgaagttaataaaagacatattaatgagcttaataaagtaataagtgaagagataagagcacagctaggcattaaaaataaaaaggaattgcaaacgaaaataaaacaaatatttactgattatttaaataataagaattggggaccggtcgacaagaatattagtcatcatgggaaaaattatggttttcaattaactcctgcctctcatatgaagatagggaataaaaatatatttgtcaaagagtataatggaaaaggaatttgttgtgcttctacgagagagagtgatcatatcgcgaatatgtggctttcaaaagtggtggatgatgaggggaaggaaattttttcgggtatcagacatggagttatatcagcctatggattgaaaaaaaactcatctgaaagagctgttgctgctcgtaataaagctgaggagttagtaagcgcagcattatatagcagaccagagttattatcacaggctttgtctggtaaaacagtagatttaaagattgtttcgacttctcttctgacgccgaccagtttaaccgggggagaggagagtatgttaaaagatcaggtgaacgcattaaaagggttaaactctaaaaggggggagccaacgaaattattaattcggaatagtgatggtcttctgaaagaagtaagcgttaatctaaaagtggtgacatttaactttggtgtaaatgaattagcgctaaaaatgggcttaggctggaggaatgttgacaagcttaatgatgaatcaatatgttctttgttgggggataatttcctcaaaaatggtgtgattggaggttgggctgcagaagcaatagaaaaaaatccaccatgtaagaatgatgtgatatatctggctaaccagataaaagagattgtaaccaaaaagttacaaaaaaatgataatggagagccgtataaattgtcacaaagaatgactctattggcttatactataggtgctgtgccttgctggaattgtaagagtgggaaggacagaacaggtatgcaggatgctgaaattaaaagagaaataataagaaaacatgaaacaggtcagttttctcaattaaatagtaaattatcctcagaagagaaaagattattttctactattctaatgaatagtggtaatatggaaatccaagagatgaatactggtgtgcccggaaataaagtcatgaaaaaattgccgctatcttcgttagagctatcttattctgaaagaataggggacccaaaaatatggaatatggtgaaagggtattcgtcatttgtataagaggaatatatggaagatttagcagatgttatttgccgagccttgggtatccctttaattgatatcgatgatcaagcaatcatgcttgatgatgatgtgctaatatatattgaaaaagaaggagattcaataaatttattatgccctttttgtgcattgcctgaaaatataaatgatcttatatatgcgttgagcctaaattactcagaaaagatatgcttagctactgatgatgaaggcggaaatctaattgcgcgattagatcttaccgggataaatgaattcgaggatgtatatgttaatacagaatattatatttcgcgtgtgcgttggctgaaggatgaatttgcgcgaagaatgaaggggtattaatgtcccgtttcgtatttattttgctgtgttttatcccatatttagggagagctgattgttgggataaggctggtgaaaggtacaatattccatcaagtttgttaaaagcgattgcggaaaaagaatccggatttaataaatctgcagtcaatgttaataacaatggaagtaaagattatggtataatgcaaataaatgactttcattctaaaagacttagagaaatgggatattctgaggaaatgctaattagtcatccatgtctttctgtacattatgcagcaaagttattaaatgagtttatgatgatgtatggaagagggtgggaggctgttggagcctataatgcaggaacgtctccgaaaaagaaaaaagaaagattaaagtacgcagaggatatctatagacgctatttgcggatagcagcagagagcaagcagaataatcgaaggatataagaggatttatgtctgaggcaaagaactcaaatcttgcaccattcaggttattagtgaaactcacaaacggtgtcggggatgagtttccgttatattatgggaataacttaattgttctcggacggacgatagaaacacttgagtttggaaacgacaatttcccagaaaatattattcctgtaacagatagtaaatcggatggtataatttatttgaccataagcaaagataatatctgtcaatttagtgatgaaaaaggtgagcaaattgatatcaattcacaatttaattcatttgaatatgacgggatttcttttcaccttaaaaatatgagggaggataaatcgagaggccatatactaaacggaatgtataagaaccactcggtgttttttttctttgctgttattgttgtgttaattataattttttccctctctttaaagaaagatgaagtaaaagaaattgctgaaattatagatgataagagatatggaatagtcaacactggacagtgcaattatattcttgccgaaacacaaaatgatgcggtatgggcgtctgtagccttaaataaaaccggatttaccaaatgcagatatattctggtgtcaaacaaagaaataaatagaattcaacaatatatcaatcaacgattcccatttatcaatttgtatgtgttgaatttagtgagtgataaagcggaattactggtgtttttaagtaaagaaagaaatagttcaaaagataccgaacttgataaattgaaaaatgctctgattgttgaatttccgtatatcaaaaatattaaattcaactatcttagcgatcataatgcaaggggggatgctaaaggtattttcacaaaggtaaatgtccagtataaagagatttgtgaaaataataaagttacatattctgtcagagaagaactgacagatgaaaagcttgagctcattaatagactgatttctgaacataaaaatatatatggagatcagtatattgagttttctgtacttttgatagatgatgattttaaaggtaaatcatatcttaacagcaaagacagttatgtaatgttgaatgataaacactggttttttttagataaaaataagtgaggataaaatgagtgttacagtaccgaatgatgattggacattgagttcattatctgaaacttttgatgatggaactcaaacattacaaggtgaactaacattggcactagataaattagctaaaaatccttcgaatccacagttgctggctgaataccaaagtaaattatctgaatatacattatataggaacgcgcaatccaatacagtgaaagtgattaaggatgttgatgctgcaattattcaaaacttcagataatagggagcattcatgaattacatttatccagtcaatcaggttgatattatcaaagccagtgattttcaatctcaagagatatcaagtctggaagacgtcgtgtcggctaaatatagtgatattaagatggatacagatattcaagtatcacaaataatggagatggtaagcaatccagaatcattaaacccagaatctttggccaagttacagacgacgctctcaaattattcaataggagtatcattagctggcacgttagcaagaaaaacagtttcggctgttgaaactttattaaagtcttaatttatatgattaggtataaaggttttattttattcttgttgctgatgttgattggatgtgagcaacgtgaagagttaatttctaatttatctcaaagacaggcaaatgaaataatatctgtgctagaacgccataatattactgctagaaaagttgatggaggtaaacaggggatctcggtacaagtcgaaaaggggacatttgcatcggcagttgatttgatgcgcatgtacgatttgccaaatccggagagagttgatatctcacaaatgtttcctacagattcattagtgtcttctccaagagctgaaaaggcccgtttatatagtgctattgagcaacggctggaacagtctttagtttctattggtggtgttatttcggcaaaaatacatgttagctatgatcttgaagaaaaaaatatatcttcaaaaccgatgcatatatcagtaatcgctatatatgactcaccgaaagagtctgaactattagttagtaatattaagcgatttttgaaaaacaccttttctgatgttaagtatgaaaatatatctgtcatattaactccgaaagaagaatatgtttatacaaatgtacaacctgttaaggaagttaaatcggaatttttaacaaatgaagtaatatatttatttctcgggatggctgtactagttgtcattcttttggtatgggcattcaaaacagggtggttcaagagaaacaaaatatgataagaatggatggaatttataaaaaatatctttcaataatttttgatccagcgttctatataaatagaaatcggttgaatttgccttctgaactgttagaaaatggcgtaatcagaagtgagattaataatctcataattaataaatatgatctaaattgcgatattgaacctttaagcggggtaaccgctatgtttgttgccaactggaatttacttccagctgttgcttattttatcggtagtcaagagtctcggttaattaatcatagtgagatggttattagttattatgggggcaaaatcagtaagcaaggggaggccgctattcgaagtggtttttggcatcttattgcgtggaaggaaaatatatctgttggtatatatgaaagaataaacttattatttaatccaattgctttggagggaaattatacgcctgtagaaagaaatttgtcccgattaaatgaaggtatgcaatatgcaaaaaggcactttaccggtatccagacatcatgcctatgatggtgttgttataaagagaattgaaaaggaattatgtaaaaccataaaagatagagacactgagagtaagaagaaagcaatttgtgttataaaggaggctacgaaaaaagctgaatcactgcgtatagatgctgtatgtgatggttatcaaattggtatacagactgcttttgagcatattattgactatatttgtgaatggaagttaaagcaaaatgaaaatagaagaaatattgaggactatataactagtttgctttcagaaaatttacatgatgagaggatcattagcactttattggagcagtggcttagttcgttgcgtaatacagtaacagaattaaaagtggttttgcccaagtgtaatttagcactgaggaaaaagttagaacttgatctccataaatatcgctcagatgtcaagattattttaaaatattctgaagggaataattatatattctgtagtggtaatcaagtagtggagtttagtcctcaggatgtaatatcaggtgttaaaatagaacttgcggaaaaattaacaaaaaatgataaaaaatatttcaaagagttagcacataagaaactgagacaaattgcagaagacttgttaaaagagaatcctgttaatgattaatcaaataaatgcaagcaatgctctgcagcaaagattaaatagtgaagaagttgttaatttaaatgagagattatcatcttcgcaatcatttgatgaggatataatctatgaaataatgcaatatttctcacagagtgaattaaattccatagataatgatgaactgcacaataagattgaacaattattcaattcacgttttccttatcttacagctgcacaaaaaagttcacttcttaataaactcatagatgcaaatcaatatgtcgatttgcatgagggattttatgcatcattgtccatatataacaatattgatttctatattaagactacaaccttcgattcattaattagtgtctttgaagcagggagagaggcagatgattcgacatggtagtaataagttgaaaatatttattttaagtatattgctattaacactgagtgggtgtgctttaaagtcatcatctaattctgaaaaagaatggcatattgttcctgtaagtaaggattatttttctattccaaatgatttattatggtcgtttaatacaaccaataaaagtataaatgtttactctaaatgtattagtggtaaggcggtttatagttttaatgcaggtaaattcatgggcaactttaatgttaaggaagtagatgggtgcttcatggatgcacaaaagatagctatagataaactattttctatgctgaaagacggggttgttttaaaaggtaataagataaatgataccatccttatagagaaggatggggaagttaaattaaaattaattcgagggatataattgtattgtgagtaaatataaaggtctaaatacaagtaatatgttttacatttactctagtggacatgaaccagttaacgttgagcttgtaaaagataaagaacgtaacataattgagctggctccagcatggaagggtttttttttgtccgaaatcaaaatataaaattcagtgataatgtgaactatcattatcgctttaacattaatagttgtgcaaaatttcttgctttttgggactatttcagtggtgctctagtagagcatagccatgctgaaaaatgtattcatttctatcatgagaatgatcttcgggatagttgtaataccgaatcgatgcttgataagttaatgttaagattcatcttttcatctgaccagaatgtaagtaatgcactggctatgatacgaatgactgagtcatatcatttggttctttatcttctgagaactattgagaaagaaaaggaggtaagaataaagagtctgacagagcattatggtgtgtcggaggcttattttagatctttatgtagaaaagctttaggggcaaaagtcaaagaacaactgaacacttggcggttagtaaatggtttattagatgtatttttgcacaatcaaacaatcacttcagctgccatgaataatgggtatgcatcaacatcccatttttcaaatgagataaaaacacgactaggcttttctgcaagagaattatcgaatattacttttttagtgaaaaaaataaatgaaaaaatttaatattaaatctttgactctcttgattgtattgttaccattgatagttaatgctaataatattgactctcatttattagaacaaaatgacatagcgaaatatgttgctcaaagtgatacggtaggatctttttttgaacgtttttctgcgttattaaattatcctattgttgttagcaaacaagctgcaaaaaagagaatatctggggagtttgatttatctaatccagaagaaatgcttgaaaagctgacattacttgtgggactcatatggtataaagatggaaatgcattatacatatatgactctggagaattaataagcaaagttattttgctggagaatatatcacttaattatcttattcagtatctgaaggatgctaacctttatgatcacagatatcctataagaggaaacattagtgataaaacattctatatatctggtcctccggcattggttgaactggtagctaatacagcaactttgcttgataagcaggtttcttctattgggacagataaagttaattttggggttataaaattaaaaaatacatttgttagtgacagaacttataatatgagaggggaggatattgtcatcccaggggtggctactgttgtagaacgtttattaaataatggtaaggctctgagtaacagacaagcccaaaatgatccgatgccaccctttaatattacacagaaagtatctgaggatagtaatgacttttcatttagttcagttaccaatagttctatattagaggatgtatcacttattgcatatccagaaaccaattctatattagtcaaaggtaatgatcagcaaatacagattattcgcgatattatcactcagttagatatagccaaacgacatatagaattatcattatggataatcgatattgataaatctgaattaaataaccttggtgttaattggcaaggaacggcttcatttggtgattcgtttggtgcgtcatttaatatgagctcatcagcatcgataagcactttggacggcaataagtttattgcttcagttatggcattaaatcagaaaaagaaagcaaatgtagtttcaaggccggtgattttgacacaagagaatattccggctatatttgataataacaggactttttatgtgtcattagttggtgagcgcaattcttcgttggagcatgttacgtatggaacattgataaatgttatacctcgcttttcatctcggggacaaattgagatgtctttaacgatagaggatggaacaggaaatagtcagtcaaattacaattataataatgaaaatacatctgtccttccagaagttggaaggaccaaaatcagtacaatagcgagagttccacaaggcaaaagtttgttgataggtggttatacgcatgaaacgaactctaacgaaataatatctattccttttctctcctctattcctgtaatcggtaatgtgttcaagtataaaacaagtaatatcagtaatattgtaagggtttttctgattcaaccccgtgagataaaggagtcaagttattataatactgcagaatataaaagcctcatatctgaaagagaaatacaaaagactacacaaataatcccatctgaaactactttgctggaagacgaaaaatcattggtttcatacttaaattactaactataaagtaggtgatgtatgcttgatgttaaaaatacaggagtttttagctctgcattcattgataagttgaatgcaatgacaaattcagatgatggagatgagactgctgatgcagagcttgattctggcttggctaatagcaagtatattgactcatctgatgagatggcttccgctctttcgtcatttataaacagaagagaccttgagaaactgaaaggaacaaatagtgatagtcaggaacgtattttagatggggaagaagatgaaattaatcacaagatttttgatttaaagagaacgttaaaagataaccttcctctagatcgggattttatagacagactaaagagatattttaaagatccaagtgatcaagtcttagcattaagggaacttttgaatgaaaaagatcttactgctgaacaagtcgaattattaactaaaattattaatgagataatatcaggtagtgaaaaaagtgttaatgctggaataaattcagctatacaggctaaattatttggcaacaaaatgaaacttgaaccacagcttttgcgtgcatgttatcgtggttttatcatggggaacatatcaacaacagatcagtatatagaatggcttggtaattttggttttaatcacagacatacaattgtgaattttgtagagcagtcactgattgtagacatggattctgagaaaccgagctgtaatgcttatgagtttggttttgtgttatctaaattaattgcaattaagatgattagaacttcagacgtaatttttatgaagaaactggaatcctcaagcttgctaaaagatggcagtttaagtgcagagcagctattgctaactttattatatatttttcaatatccaagtgaaagtgagcaaattcttacttctgttatagaagtatcacgagccagtcatgaggattctgtagtgtatcaaacatatctatcttctgttaatgaaagtcctcatgatatatttaaaagtgaaagtgaaagagaaattgcgatcaatattctacgagagcttgtcacaagtgcatacaagaaagagctttctagataacaggagataaaagtgatccagtcttttcttaagcaagtaagtactaagcctgaattaattatattagtgcttatggttatgatcattgctatgttgatcataccattacctacataccttgttgattttttaatagggcttaatattgtacttgctattctcgtttttatgggatcattttatattgaaagaatattgagtttttctacattcccttcggttttgttgataacgacattatttcgtctcgctttatcaataagtactagtcgactaattttagttgatgcggatgcgggtaaaattattactacatttggccagtttgtcattggtgatagtctggctgtaggttttgttattttttcaatagtaactgttgtgcagttcattgttataacaaaaggatctgaaagggttgcggaggtagctgctcgcttttctcttgacggtatgccggggaaacaaatgagcattgatgcggatttaaaggctggaattattgatgccgcaggagctaaagaaagacgcagtattctggaacgtgagagtcaattgtatggttcatttgatggagcaatgaagttcattaaaggtgatgcaattgctggcatcattattatttttgtcaatttaataggaggtatttctgttggtatgagtcaacatggaatgtccctatctggtgcattatctacttataccatactaactattggtgacggattggtctctcagattcctgctctgttaatttctataagtgcaggatttatcgttacaagagttaatggtgatagcgataatatgggacgtaacataatgtcccagatatttgggaatccttttgttctcattgttacatcagctcttgccttggcgatagggatgttgccaggttttccgttttttgtttttttcctgatagcagttactttgacggctttattctattataaaaaggtcgtagaaaaagaaaaaagtctgtctgagtctgattctagtggctatactggtacatttgatattgataatagccatgactcatctttggcaatgatagaaaatctggatgctattagttcagaaaccgttcctttaattttattatttgccgaaaataagataaatgcaaatgatatggaaggtcttattgaaaggataagaagtcagttctttattgattatggtgtcaggcttccaactattttatatagaacaagcaatgagcttaaggtcgatgatattgttttgttaataaatgaggtgcgtgccgatagttttaatatatactttgacaaagtgtgtattacagatgaaaatggagatatagatgctctaggtattcctgttgtttcaacttcatataatgaacgtgttatttcttgggtagacgtttcatatacagaaaatctaactaatattgatgctaaaattaaaagtgctcaagatgaattttatcaccagttgtcacaagctttattaaacaacataaatgagatttttggtatacaagaaacaaaaaatatgttagatcagtttgaaaatcggtatcctgatctattaaaggaagtcttccgacatgtgactatacagagaatttctgaggtattacaaagattgcttggagaaaatatttctgttcgcaatttaaaacttattatggagtctttggcgctttgggctcccagagaaaaagatgtcataacattagttgaacatgtccgtgcatcactttctaggtatatttgtagtaaaatagctgtttctggtgagattaaagttgtgatgctttccggatatattgaggatgcaataagaaaagggataaggcaaacctctggtggctctttcttgaatatggatatagaggtttcggatgaggtaatggaaactttagcacatgctttgagagaattgagaaatgcaaaaaaaaatttcgttcttttggtatcagtagatatacgtaggtttgttaaaagacttatagataacagatttaagagtatactcgttatatcgtatgctgagattgatgaagcatataccattaatgtattaaagactatttagtgaggtttaaatatgagtaacattaatttagttcaattagttagagatagtcttttcacgattggttgtcctccatcaattattacagatttagacagccattcagcgattaccatttctttggatagtatgcctgctattaatatagctcttgtcaatgagcaggttatgttatgggctaattttgatgcaccaagtgatgtaaaacttcagtcatctgcttataacatattaaatttaatgttaatgaactttagttatagcattaatgagctggtagagcttcatcgttctgatgagtacttacagttaagagttgttattaaagatgactacgttcacgatgggattgtttttgcagagattctgcatgagttttatcagaggatggaaatcttaaatggggtcttataatcaatgagctatacaaaattgctcactcaattatcttttcctaatagaatctcggggccaatcttggaaacaagtcttagcgatgtttcgattggtgagatttgtaacattcaggctggaattgaaagtaatgaaattgttgcaagagctcaggttgtaggatttcatgatgaaaaaacaatattaagcttgattggaaattctcgtggactttcacggcaaacgttgattaagcccactgcccagtttcttcatacgcaagtcggccgtggattattgggagcagtagtcaatcctttaggggaggttactgataagtttgctgttacagataacagtgaaattctttatcgacctgtagataatgctcctccgctatatagtgaaagggctgcaattgagaagccttttttaacaggtattaaggttattgattctttactcacgtgtggtgaaggacagcgaatggggatttttgcgtcagctggttgtggcaaaacttttctcatgaatatgctcattgaacatagtggtgctgatatatatgttattgggttaattggtgagcgaggtcgagaggttactgaaacggttgattatttgaaaaactctgagaaaaaaagcaggtgtgttttagtatatgcaacttcggattactcttcggttgatcgttgtaatgctgcatatatagccactgctatagccgaattttttaggactgaaggacataaagtagcgctttttattgattcattaacaaggtatgccagagcattacgtgatgtggccttagccgctggagaatcacctgccagaagaggctatccggtttcggtttttgatagcttacccagacttcttgaaaggccaggaaagttaaaggcaggtggctctattactgcattttacactgttcttttggaggatgatgattttgctgatccattagctgaagaggtaagatccattttagatggacatatatatttgagcagaaatctagcccaaaaaggacaatttcctgcaattgattccttaaaaagtataagcagggtatttacacaggttgttgatgaaaaacatcgtattatggccgctgcatttcgggagctactttctgaaatagaagagctaaggacaattattgactttggtgaatacaaaccgggggagaatgcctctcaggataaaatctacaacaaaatatctgttgttgagagttttctgaagcaagattatcgactcggttttacttatgagcagacaatggagcttattggtgaaacaattagataaggttttaaaaatcaaagataaatatcaacggtctgttaaattaattgaagcacacatattaacactaaaaaaaaaactctttgtatcgagatgtggaggcattagataaaaggattatatacttcctgcaactggagaatgacttagaacctgtaggcgctcagagtgttagtcagcttttcaatacaagacgtaagatcgctatagtaaaaaagcatattatccaatatcagtctgaacgaattcttctaaagggaagaattgaagaaattcaaaaagatattgatgaggcaaatgcttctaaaagaaaactgcttcataaagagagtaaaatatgtaaacggattggcttgattaaaagaaataactttgccaaacagttgatacttgatgagttatcacaagaggatatgaagtatggcattagataatataaacctaaattttagtagtgacaaacagatagaaaaatgtgagaaactatcttcaatagataatattgatagtctcgttttgaagaagaagaggaaggttgaaattcctgagtactctttaattgcatctaactattttactattgataagcactttgaacataagcatgataaaggagaaatttatagtggcattaaaaatgcgttcgaacttagaaacgaacgagcgacatattctgatattccagaatcaatggccattaaagaaaatattttgataccagatcaagatatcaaagcaagggaaaaaataaatatcggcgatatgagggggatcttttcatataataagagtggaaatgcagacaagaacttcgaaagaagtcatacttcttctgtaaaccctgataatctgctagaatctgataatagaaatggtcaaattggtttaaaaaatcatagcttgtctattgataagaatattgctgacatcatttctttactaaatggaagtgttgctaaatcatttgagctgcctgtaatgaataaaaatactgcagacataaccccatccatgtcattgcaagaaaaatcaatagttgaaaatgataaaaatgtttttcaaaaaaatagtgaaatgacttaccactttaaacagtggggggctggacattctgttagtatttcagtggagtctggttcttttgttctaaaaccgtcagatcaatttgtaggaaataaacttgacttaattttgaaacaagatgctgagggtaattacagatttgatagcagtcaacataataaggggaataaaaataatagtacaggatataatgaacagagtgaagaagaatgctaagaattaaacattttgacgctaacgaataaatacagattttatatgcaaagcaactctgcgagcgtttttcgattcagacattcaaaaataaatttacaggcagtgaaagtttagtcactcttacttccgtgtgtggggattgggtaattcgtattgatacattatcttttttgaaaaaaaaatacgaggtattttcaggattttctacacaagaatctttactgcatttatcaaaatgtgtctttatagagtcgtcatctgtattttcgattccagaactgtctgataagattactttccggatcacgaatgaaatccagtatgcaactactgggagtcatttatgctgtttttcctcttctttaggtattatttattttgacaagatgccggtattacgtaatcaagtttctcttgactcattgcatcatcttttagagttttgcttaggttcatctaatgtaaggctggctactttaaaaagaattcgcactggtgatataatcatagttcagaaactttataatttattattgtgtaatcaagttattattggggattatattgtgaatgataataatgaggcaaaaattaatctgtcagaaagtaatggtgagtcagaacacacagaagtttctttggcattattcaattatgatgatatcaatgtaaaagtggactttattcttttagaaaaaaatatgacaatcaatgaactaaaaatgtatgtagaaaacgaattattcaagtttcccgatgacatagttaaacatgtaaatattaaagtaaatggttctttggttgggcatggggaacttgtttctattgaggatggttatggtatcgagattagttcttggatggtaaaggagtaatctcatgctgagtgacatgtccctcatcgctacactttctttttttacgctattaccatttttagttgctgctggtacctgttatataaagttttctattgtttttgtaatggtacgaaatgcacttggtttgcagcaggttccatcaaatatgactctcaatggtattgcattgattatggctttgttcgtgatgaaacccattattgaagctggttatgaaaattatctaaatggccctcaaaaatttgatacaatatctgatattgtccgtttttctgattctggcttgatggaatataagcaatacttgaaaaagcatacagatcttgagttagcacgttttttccaaaggtctgaagaagaaaatgctgatttaaagagtgcagagaataatgattattcattgttttccctcttgcctgcatatgcgctaagtgaaatcaaagatgcgttcaaaataggtttttatttatatttgccatttgttgttgttgatcttgttatttcaagcattttacttgcacttggtatgatgatgatgagtccaatcacaatatcagtaccaataaaacttgtattatttgttgcgcttgatgggtggggtatcctgtctaaggccttgattgaacaatatatcaatattcctgcttagatgatggaggtaatgtgtctgatatagtttatatgggtaataaggctctttatttaatccttatcttttccttatggccagtaggtatagctacggttattggattatctattggtttgttacagacagtgactcaactccaagagcagacacttccttttggtataaagcttataggtgtctcaatatctttgctacttctttctggatggtatggtgaggttttattgtctttttgtcatgaaataatgtttttaattaagagtggggtttgatggacatttcaagctggttcgaaagtattcatgtgtttttaatactcctgaacggcgttttttttagattggctccattatttttctttcttccatttttaaataacggtataatttctccatctattagaatacctgtgatttttcttgttgcatcaggattaattacttctggtaaggtagacataggttcttctgtttttgaacatgtttatttccttatgttcaaggaaataattgttggcctccttctctctttttgcttgtctcttcccttttggatatttcatgctgttggtagcattattgacaaccagcgtggggcaacgcttagtagttcaattgatcctgccaatggtgttgatacgtctgagttggcaaaatttttcaatcttttttctgcagttgtatttctatacagtggtggtatggtctttattttagaatccatacaattgtcttataatatatgcccgttattttctcaatgttctttccgtgtctcaaatatcttaacatttctgactttattggcaagtcaggctgttattttagccagtcctgttatgatagtattgttactatcagaagtattacttggtgtattatcgagatttgctccgcagatgaatgctttttccgtatcattaactattaaaagtttacttgcaatatttattattttcatctgttcttctactatttacttttctaaagttcaatttttcctcggtgaacataaatttttcacaaatctatttgttagataaaatattatggcaaataaaacagaaaagccgacacctaaaaaactaaaggatgccgcaaaaaaaggacagtcatttaaatttaaggatttaacgactgttgttattattctggtagggacatttactataatatcattcttttccttaagtgatgtaatgctcttatacagatatgtaataattaatgacttcgaaattaatgagggtaaatacttttttgcagtggttattgtcttttttaagataattggcttcccactttttttctgtgttctttcggctgtgttgccaacattggttcaaacaaagtttgttcttgcgactaaagctatcaagattgatttttcagtattaaaccctgttaaagggttaaaaaaaatatttagtataaagacaataaaagaatttttcaaaagcattctgcttcttattattctagcattaacaacctatttcttttggattaatgaccgaaaaataattttttctcaggtgttttctagtgttgatggcttatatcttatttgggggaggctgtttaaggatataatattatttttcttggcattttctattcttgttattattcttgactttgtgattgagttcattttatacatgaaagatatgatgatggataaacaggagataaaaagagaatatatagagcaagagggacactttgagacaaagtcgagaaggcgtgagttgcatatcgagattctttcagagcagactaaatctgatatacgtaattcaaaattagtggtaatgaacccgactcatattgcaattggtatttattttaatccagaaatagcgcctgcaccttttatttctctcattgaaactaaccagtgtgccttggctgtcagaaaatatgcaaatgaagttggtataccgactgtgcgtgatgtgaaattagctagaaaactatataaaacacatacaaaatatagttttgttgattttgaacacttggatgaagtcctacgtcttattgtttggcttgagcaggttgaaaacactcattaataagtaaaggagatgtgttatatgggagttaatttctgtaataaaataggtattgatcagtctgaatttgaaatagaatcttccatcattaactccattgctaatgaggtattgaacccaatatctttccttagcaataaggatataataaatgttttactcagaaagatttcatctgaatgtgacctggttagaaaagacatttatcgttgtgctctggagttggtcgttgaaaaaacacctgatgatttataatcattcataataactcttttgctgatataaatatttttgttgaagatatttatgtagtcacaggatcaattgtagaaaattgttatgtttttgttaggaactgcactaaataatatatgataagacagcaaaaacgactgaccataatccttcttttattaggagttgataagagagactattcatcctgtaatgttaaaactctgttatatagtattcgcgattatgcaaagtctgtaaatgatcatgagatactaaccgagagtaatcgtttattatctcattgcatttcagatagtaacggagctttctttaaaagtagtaaatacgttccccttaagtacttacgtaaaaggagaatagcacgaaagataccaaatgattagcactttgctagtaagcttgctggtaaactatattgaccgttgggtttgttttgagactgtaatttaaattgtgtaattgcctgtttttgatatgtttactccaacaacggagacaggtaaattatggacgaaaagaagcttaaagcccttgcggctgaactggctaaaggcctcaaaactgaggccgacctcaatcagttttcccgtatgctgacgaaatatcccggctcttaaaacgatagtggctcaggctttcatttttcagcgttccccagaagatttccatcggagcgttgtcgtaacagttacctttacgcgacattgatgttttcagaccagactgctcctgtatgacccggtaatcgtatgcgcagtactgtgaacctcgagcggagtggtggattagcccggcaggtgggtgctggctcctgagcgccataaacagggctttacccgtcaactctttcgtcatgcgctctcccatggcgtaaccgacaatttcgcacgtataaacatctttgacgccagcgagatacagccatccttcccgggtggcaacatacgttatatctgcgacccagacctgattaggtgctgtgggcgtaaagttctgattcagcagattcggcgtaaccggcagattgtggtcagagcttgtggtcgccctgaacttgcgtttctgcttacagtgcagcctcagctccttacgaagacgtgccagtctgtcacgaccgacgataattccgttatctgccagctccgtctggagccgccgggttccatatgtttcgcgagtgcggatatgtgccaccttaatctccagttttagccgctcatcactttgttttctgtctgagggggcatgctgtacccggtcgtaataaccgctcctggatacaccaggtacccgacacatcgcttcaacagggaattgttgtcgccattgttcgactaacgcgtatttttcagcgactcctgtgcaaaatacgctgttgctttttttaatatatctcgctcaagtcgtgcttcatttaaagccttacgcagttgcataacttcagattccagctcagccactgtgcgggagcctggtgtattgagcccttttcttgcggcggtaacccattgtcctaaagtgccttcaggaacagataatcgggaagcgccttcactgatcgaaagctgattttcaggaaccgttttgacggcttcggctttaaactccgtagagtaacgttgggtttttctgctcattattggctccttctgatgccattctatttcaggaaggagtgtccgttaaactcaggctacctcaaactgttacgacaacgctccgatggaaagcttctggggaacgctgaaaaatgaaagcctgagccactatcgttttaagagccgggatgaggccatctcagtaatacgggaatacattgagattttctacaatcgtcagcgtcgtcactctcgtctggggaatatctccccggcagccttcaggataaaatattatcagatgactgcttagaaaaagaacaaatggtggtgtccgctattgccagtacacctcaggccatgtgcgcggtaactgaccgggctgaaccacggcagcctgacggctgcaaattgaaaactgcccctgttcgtcctggtgttgccgcacgctccgcagaatatgtatgctctgaggacctgttttattaaggactcatcctcttatgttgacccgcaaaagtatagataccgttctgctctctgttggtgctgagaagctctcacaacgtgaatgggactggatgaagatgctcaaacccatggacccaccacctgcgatggtcgcggcctccatcctggagcgccgtggcgacacagcagcccttacccggctacaggataccgggggttaatccgtcctcatgttgtccgcttttactccccgcccgctgaaacgtctgttcacggccaaccagtgctggacatccttcctggatgcgggcggtctgcgcgatatcgaggttgaggctgtcacaaaaatgctggcctgcggcacgcggatactgggcgtgaagcatatacatctgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcaccctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatacgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggagggggagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgtggacagcggtatcgtctggtttttcaatttcctatacgtgaacttccgggaggcctttgccctcagcccctgacggcgcaggcttgccgccacggtttttacgttaaagtggtaaccctgagcacgcagttcatccgtcaggcgtggtgcaccgtaacgctgttttgaccgggtaaaggccgccgcgaggacaacgctgtcgcagtgctgacggaactgctgacgagggcttattcctgtccgacgctgacaccacgtataccagccgctgcgcaaagtatgtcgcggccttttggaggatagccagttcctctgcctgctccgccagttgccgcttcaggcgggcagttcactttcacgctcagacgaggtcatctgttgctgcagtttgctgcgccacgcatagagctgagattcatacaggctgagttcacgggctgcggcagcaacaccgatgcgttcagcaagcttcagggcttcactgcaaaattcaggcgaattctgtttacgtgtttttttgctggttgatactgtttttgtcatgtgagtcacctctgactgagagtttactcacttagccgcgtgtctactattgctgggtaagatcacatctcatcgcttacagccactacaggacgtttccgtatcctgtgaattatcatcccacgtggactgcatatatttttaatacacacaacccctcttccagccacatgcagtgtcgaggtggtcccgcagattccgtatacccgacaccctgcacgggttccgagtatctgtactcccggtggtttatcagagtaatagtagtcactgttacattcgacccagctctttcccccggggggatgcgggaccactcggaaatacaccccatatggtccgtgcacattaatctccgcatagcaatgttctgttgaattacgtggcatagccagtaaagtctcttttgcagcagcgggtaccgcataccacatacacattagtgcaactatcagcgcagtattcattttcattgtcactttccgttactggtgctgtccgtcacagcacctcatgtcctgcggacagggcaagctgaccggccataacaactttcagttccatcagggaagtggaagctagacgccggacaatcaaatcccgccggcggtacaccttcttcgcagcagagttgttcagtcaacatgaaagtgacagacagtgtcaccacgatgcagcatcagtatgacggtgaatcgccggtcgtagtttttgttctttgttttatagggagctttctgcatcaggcatcgttcatcacggggtattggtgcaatgctcggcatcactcagtccggctggtgatttgtgatgtttggcaatttatctgattacataatccggactgagtcccccctgagtgttttactgttccgagcacttatttagtaactttcttgcatagttgtttctggctttaattgtgctgccctaaggtttgtttctcagtatgacagctcaatacatatacttcgaacgcattatatattcatttaattcactttgtgggagaggattattactttctgacataaacatcattgatttcataaaatcccgactgttctgtattaaatattaagaatctgttactgtcatctttaaatgaactagataaaacgagccgtgaatcataacgagcaagaacataataccaactattattataacaaagcatctgatattctttttttaattgaggtttataccagccaacaagaaaggaaaaaaaccaaaaataaaccaaaaaaccagccataattaacttaatgcggtgttctctaacaaaagggatatctgaaaaacatgatacagaaaagatccgtccatatatacgaattattattgaaataaccaatgaactaataatgaatgaaagtgataatggaagtatgaaatattgtttgagaattaaaagttcgaatattacagggaaaaacagtagggtaatagcaaaaaatagtctaaaaaaactcaagtcttgtattttacttcttttctttataagaagaaaaaataaaataccaatcccccaaccggtaaaaagtatacccattactatgatagcatagagtaaacttctggcaacatcatccaaacctgcaccaacaacccaccatggaaatccatagtaaaaagaggttccccagccataagaataagcactgacccaccctacacatcccatataggcgatgaataatgaagaatttctaagcaatgaattgtcattcataagaaactaactgataatgtaaaaaatattcgagataaaagttgatcttttaattttcatgctaggaaattaacaataatatcattgttaatgcatatttatcatatcaaaatactctgcagaatgctactatcaaaaccagacaagtgaacaaaacttggtcaacatttagtaacgctagttggtaatgtcttcaatcgatagaagtttctggtaatctactggtattcaaacagttagggctcatacagcttgctggaccttccccataaccgcccgaacgtgaaggtctgatgtgttgcaagagagccggatgcgggaaatctgcaagtccggttcgatgagagggacgttgtttttacttgttgttgatgaagactttcattattgaacagaatgataatattgtctaaacaaaacattaaatctcataattctttgtagaaaacgcttttcttgaaattaaaaataagtagaatcagcagtctcattataataacagacaatgtcatgctctcgcccgttccggtaataaacggagcgggctatctttttggaatatttatggcccacaatccagttttcataaatacgattcattccattcttcgttttttctgagcattgcgttcataatggtcagcaacttacgcatacaggcaaccagtgccacttttttggcgtttccggctgcaagtaggcgcatgtaaaacgcctttatcaccagattaaaccggggggggcctcaagcgccgccatgtacagagctgttcttccccagcacaatcaccgaaaatggttcgtcgaccgcgcagagttcccgagtcccggtttacctgagcaacaccgacaagtgcgctgatttcacgtctcgagaggctgctcgattcaggcatttccgccagcaatgctgcggcagtcatggctctaacacctcagacgttcagtaagctctttaaagtaactctgaatgtgcctgttcatatctgggtcttccccgatcatggtgggaaggcttagaacgctatattcagtttcccatagtggaacatcactcccagcttaaagcgctcccggttgcggtagcccttggcttttattctcagcagcctgatcttgctgttcagtgcttccgcatttccgtttgatacgccatggcgcatggcgttcaggataccgtacaaccttttccctatcgttttagccacattcttcatcatggggacgtcactgttggccgcagccatctctgccagtcgttgcgtctttcctcgctccatggtctgctccagatatcctttgccagttctttcagcgcccagcacaggctcgtcagcttcatctgtgcacgcagccatatcagcttttcctgcctggattcggtcatccatttatcgctgtgctgccacaggaagcgagttccctttgcctgacgacgactttcaacaggaagatgcggatgttcattctgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctggggtcgccagcatgagcgggataccgggggcggtgatggagggctcaccaccgctgaacgtcagcgtctgaaagagccggaacgtgaaaatcgtgaactgcgccgcagtaacaatatccttcgcctggcttccgcttattttgcaaaggcggagttcgaccgcctctggaaaaaataatgccactgctggataagctgcgtgagcagtacggggtcggaccggtatgcagtgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcggggcttcgtctatgtggcgttcatcattgatgtgtttgccggatacatcgtggggtggcgggtctcatcgtccatggaaacgacattcgtgctggatgcactggagcaggcgttatgggcccgtcgaccgtccggcacggtccatcacagtgataaaggttctcagtatgtatcgctggccttgcacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactaacgtgggtggactggtataacaatcgacgattgcaggaaaggctgggccacatccctccggcagaagcagaaaaagcttattatgcttccatcggaaacgatgatctggcagcctgagttcacagataaaacactctccaggaaaaccggggcggttcattctggcgggttttatccaccacctcacccggttgtttcgccacatgaaagcgatcgaaggctattttctcaaccgcattgggtaagtggatgcgcgctgctcttatatagcctgcattcatgtccatcgataggaatttaaatccccaaaagattaaaaaagcaccgaagaatgcgcgtttattcaacacaacctgatcatcaagtaatcggtatagacacttaatattgcttacattgattgattcaatgtatctctgatggttttttgctccgttcccctcaacatggacgcaacttcccctctgcgactctcagccgccccaccgtattcgagccagctgctcatgcatcataacctgctctgccagacggtaacccctcttcagccccgtaaaccgcatctgacctccgcgcagctcgcacttcagcgggtcaaccttcagtcactgctgatacatccctctccttgtgatttgcctcgccgtttttctcactgtctccgttatggcgtacaccacatcttccagtaatcgccgcttcaccggactcaggaccccgtatcaccatccggaaccccttatccgccacatgccaggagaacctttccataaactcgtcgccactcatcacaaggttttcttctcgttttgtccggtggctgttgtaacgcaggccaatttcatcctgaccggcataatgttccaggcggctcatctgcaccggctgcttctccagccagttaagccatcggtttccctgctgaaaaatatcggcaaaacggggaagcatcagaaaggcggaataacgccatccggccagtgaaccgtaccgcattcagggcaatacatgccgtcggcgttgataccggcaggaattgtcgcaaattcccgctccgtgcagcgggcaatttccggatacccttcgtcatcaacacgtacaaaccagaagaccagttttttgtttccggcatccacaaagaacggaatattcaggtctgcgcaacactcaacggcatcgtcaaaattatcaaagcgcagaacctcagcttcttcttcgtcaaaaaaatcatcttcgtgaagttttacgacatagcggaggagtttgcttctttgaggtgcaggttttcgtttgcgtggtttagctgaacgggccatataactacctgaaagacaatgatattgtctgtttttataacggtaatcacaggccatgacaagccgcagccgtcaggccgcctactcggggcggtttagaacgcttatttagtaccagatcttacttataataaaggggcttggcagtttggataaactattgtccttattccactaatacaaactttttgtaaagtatattaaatatacttcatttcatactgaaatccccggaagtattcaatcaaacaattacaccataaaaggaagagggggccccaattaagttgtcaagcatgtttactgcgcaatcgcttggtgctccgtccctgtaccccgcattggtactctggcgctcatggggcttccacttgcgcttctcccttcacatcggggtgacaggtccacgttccccacaagagcctgaatcgacttcacgccgcttttatgccggatgccgcgcaggcagtaaacatatcccacaggaacgactccaccattgttttgacatcatctatatgctttcgacacatcatcagcggttcactttcgttcgtctcttcgaaccatacctgatcggctcacgtccgaccttttcccatctcgctcaccaccacatctcttaaatgcagcagcagtggatggtttggtgcctgcgcctgcacgccgacaccaaggggccttccctcatctcttgtgctgcatggctgcacagggactcacgtccccaggacgcgccttcgtggcacacagtcatcggcatagcaacagtaagcaacggcaggtttccattgccagttttctttgacagcagtacttcggcctcgctggatactgtgattccagtaccagcgatcctttctggcttttccactcaggtagcgtttattcagatactggtcgaactcattcagtatgatgttcgacagcaacggcgagatcacaccgccctgtggcatactttcactgaccgcccggaagagaccaacatcaacacggcgttttccacagcagtctcataaaacgtgtatcactgatcctgcggcagacggctttcatcagcagccggtgatgtactgtgtcgaagtagctggacaggtcaccttcaataacccggcgccccgtgtttccccgcagtcggtgagctgtaatagtacgtgatgtctcccgcccacttctggttcgggccactggcgtaaaaatcctgcgtcagcagattttctgatacaggcaggccgtgtgcacggtaactgatcgggctgaacttctgggaggcttttgcgctcagttcctgacggcgcagactggctgccacggtttttacgttaaagtggtaaccagagcacacagttcatccgtcaggcgtggggcaccgtaacgctggactgggtaaaagccttgcggacaacgctgtcgcagtgctgacggaactgcggacgtgtgtttatccttgtccgccgctgacaccacgtataccagccgctgcgggccacccggagtacgcggcacattgccttgatgacggtttacgcggtcgcctgcggcaacggctttccggctgacggtagtgtggacctttttaccccggagaacaccggcaagccccataaccgccatgagacgtgccacagtgcatctggccactctgataccttcccgtaacaactgatgccagactttacgcacagcgtatacctgatgattctcatcgtatacgcgcagtatctctttcttcagccagtcatcgcgctgcgcacgggcactgcgtttatcatgatgatgtcgctgttgctgacagtggtaatacgttgatggggcaatatgcagttcactgcataccggtccgaccccgtactgctcacgcagcttatccagcagtggcattattttttccagaggcggtcgaactccgcctttgcaaaataagcggaagccaggcgaaggatattgttactgcggcgcagttcacgattttcacgttccggctctttcagacgctgacgttcagcggtggtgagcccacctcaccgcccccggtatcccgctcatgctggcgtacccagacacgcagagtttccagtatacagccaatctttggggcaatggaacaaatcgctgcccattgtgagtcatattcgccctgactttccagaaccatacgaactgcccgttgacggacttcaggggaaaaacgtgtatttttagtcatcctgtttacctctttctcagggagtttagtctccaggatttccggggcggttcataatgatataaaaaggatgggctgagattctattggtccccatccttttagctttggtttaatagtttatagagctgttctgaagaacgtttttttacagtctggcagccaatataatattggcttaaacatcaggagatatgatggcaaatgatacttgacgactttctggagggatagcattgcgaagcccttcactgcttggaagtgttccagcatgaacgagatagcttgtttctattttattaataccaacaccattacatgttatgtgcgatggtaatattgatgagctaacttcgtaagccctccccccagaggcagagattgcagtgtcgtttttagggacaactgcgttgatttttataatatgtccacaattgttaataactcgttgttcaggcatgaaattaagcctgttttctatgttttcggacataatttgggcatatatgtgttccacagaggaagacgtgatgtgaagagattgccagaatgcagatgttagtgcagatataaatgcagggtcttgaaagagtgaagtaaacaaaagtttttctgtttgaaaacataggtcttgttgggggaagtttgaattgattattttatttacttggttgtaacttagcatttgaagctcttttttgctatcaatgaattcattaattcctaactcattaattagatctgcaattaattttagtggtatttcaatattgttgaaatatatttttgtactattgctgtcagatgctcgaatatctctgtaaatatcatgccaaacactattaaaatcagtgtctttaacgtggaagtaatcatcgtttggtattatcgatgtacagcaattaatggctgtttcaataacttctggtgcaggcttgtgagttttaaaattccctgataccggagctgtaatagtatgtacttttcctaagttgaattgtttgggggggagtgaacttaacaagttattatattcttttgatgaaagttgagtggattgtattttatctccatcaagataaaaaaccgaacatatgcctttgttaaggcatagccgtattgaaatgccatctatgtttgcgtgggcaaactctccgtccattttatcttgtgatagtgatggtgagaaactatccattagttttttttcgctatgtttttcggctagagtttcgtgtggagaatatatgccgaaagttattattttcagtaaaatgtcacaaaaactcaatttattccaacttacttctgtagttgatttgacagttgacatccatgatgagtcatttctttcatggttagttatgtttgatgtctgcatttgatttctcctgatgtattttcctattaatgccaatatatattaatataattaaattgggaacataataaaatggaatgttattcttctctttaagaaaacgatacatttccactaaaaacaattatgcagttattgcattggagagtctggtaggaaagttgtgatatgaatacattcatgttattggctttggggattaacatcaaggggcagatagaaccattgggtgtatagaaaaacaaagtggttaaactttgggcaagcgtacagaaagaactgaaaagttgcggtctgaagcagactatcatagtaaaattattaatttattatcgaacatatagctttccccctctttttttcaaagcaagacacaggtaaatttctcccgttgcattgatatataacacagctctcatgttttggttgaggctttgtttaatatgtttttgcatatatcgtccctttattccggataaaacggaatcttttcaggggtttatcaaccacttactgataatatagtgcatgaatcaaattcacaaatttttttgtaatatgacccaatgttcacaggggggggccggagaattacctacggtaaaggaaaaaacatgcaaattgtctttttctccttttgttgttggtgcatccctgttgctcggggggccaatagcttttgctactcctctttcgggtactcaagaacttcatttttcagaggacaattatgaaaaattattaacacctgttgatggactttctcccttgggagctggtgaagatggaatggatgcgtggtatataacttcttccaacccctctcatgcatctagaactaagctacggattaactctgatattatgattagcgcaggtcatggtggtgctggtgataataatgatggtaatagttgtggcggtaatggtggtgactctattaccggatctgacttgtctataatcaatcaaggcatgattcttggtggtagcggcggtagcggtgctgaccataacggtgatggtggtgaggctgttacaggagacaatctgtttataataaatggagaaattatttcaggtggacatggtggcgatagttatagtgatagtgatggggggaatggaggtgatgccgtcacaggagtcaatttacccataatcaacaaagggactatttccggtggtaatggaggtaacaattatggtgagggtgatggcggtaatggaggtgatgccatcacaggaagcagcctctctgtaatcaataagggcacgttcgctggaggcaacggaggtgctgcttacggttatggttatgatggctacggtggtaatgctatcacaggagataacctgtctgtaatcaacaatggagctattttaggcggtaatggtggacattggggggatgctataaatggtagcaatatgaccattgctaatagcggatatataatttcaggtaaagaagatgatggaacacaaaatgtagcaggtaatgctatccacatcactggtggaaacaattcattaatactccatgaaggttctgtcattactggtgatgtacaggttaacaattcatccattctgaaaattatcaacaatgattacactgggaccacaccaactattgaaggtgatttatgtgctggtgattgtacaactgtttcactatcaggtaacaaattcactgtttcaggtgacgtttcttttggtgagaacagttctttaaatttagctggaatcagtagtctggaagcttctggaaatatgtcatttggcaacaatgtaaaagtggaggctattataaataactgggcgcagaaggactataaactgctaagtgcagataaagggataacaggtttcagtgtttctaatatatctatcatcaatccgttactcactactggtgctattgactatacaaaaagctatatcagtgaccagaataaattgatctacggtttgagctggaatgatacagatggcgacagtcatggagagttcaatctgaaagaaaacgctgaacttactgttagtactattctggcagataatctcagccatcataatataaatagctgggacggaaaatccctaacaaaatcaggggagggaactctcattttggcggaaaaaaatacctactctggtttcaccaacatcaatgcaggcattctaaaaatggggacagttgaagctatgacacgtaccgctggtgttattgttaataaaggtgctaccttgaatttttcaggcatgaaccaaactgttaacactttattaaatagtgggactgtgctaatcaataatattaatgccccttttttgcctgaccccgtcattgtcacaggtaacatgactctggagaaaaacggtcatgttattctcaataatagttcgtcaaatgtcggtcagacctatgttcagaaaggtaattggcatggaaagggcggaatattatctttgggcgcggttctcggcaatgacaacagtaaaactgaccggctggaaattgcaggccatgcgtctggtattacctatgttgcagtgacaaatgagggaggctctggagataaaactcttgaaggtgttcaaattatttcgacagattcttctgataagaatgcttttattcagaaaggccgtattgttgctggtagttatgactatcgcctgaaacagggcactgtatctggactgaataccaataagtggtatctaactagtcagatggataatcaagaatcaaaacagatgagcaatcaagagtctactcaaatgagtagtcgccgagctagttcacagcttgtatcttcacttaatttgggtgaaggtagtattcacacatggcgccctgaagctggcagttatattgctaacctgatagcaatgaacacgatgtttagtccttctctctatgaccgacacggtagcactattgttgatcctactacaggtcagctcagcgaaaccaccatgtggattcgtactgttggtggacataatgagcataatttagctgatagacaattaaaaaccacagctaacaggatggtttatcagattggtggagatattttgaagacaaacttcactgatcatgatggcttgcatgtgggtattatgggagcttatggatatcaggatagcaaaactcataataagtatactagttatagttcacgaggaactgtgagcggttatactgccggtttgtacagttcttggtttcaggatgaaaaagaacgaacaggtctatatatggatgcttggttgcagtacagttggtttaataatacagtcaaaggagatgggttaactggtgagaaatattccagcaaaggaataacaggagctttggaagctggctatatctacccaaccatacgctggactgctcataataatattgacaacgcattgtatctcaatccacaagtccagataactaggcatggggtaaaagcaaacgactatattgaacacaatggcactatggtcacatcctctgggggcaataatattcaagcaaaattgggattgcgtacatccttaattagtcagagttgtatcgataaggagactcttcgtaagttcgaaccatttttggaagtgaattggaaatggagctcaaagcaatatggtgtaattatgaatggcatgtcaaatcaccagataggcaaccgtaatgtgattgaactcaaaactggtgtgggggggcgtcttgcagataacctaagcatctggggaaacgtatctcagcaattgggtaataacagttacagagacacccaaggtattttgggtgtgaaatataccttctgataataaaaatgcagggcgtgttgatgtcctgcatttctctgggacccaccgtgtaaaagctcggtgggtttttgtgcacatgatggtatgcctgcgatcaatgccaaacgtgtttaccagatcatgcgccagaatgcgctgttgcttggcgttacacaggaattgcattagaaagcgatgaacgaatgctaccgccaaatattcgtggttatgcgcctcagattactggtattgcagaaactaatgcacgtgttgttgtatctcaacaaggtcgagtaatatatgactctactgtaccagctggaactttttctattcaggacttgagtagttctgtacgaggaatattggatgttgaaatttttgagcaaaatggtaaaagaaaacatttccaagtagaaatgtgcaggtgtgcctttcttatccagacttggtcagagtaggtataaattagtaacaggtctacctaaaacaaataataaagcaactggtgatgcatttttttcggtgaagatcctacggggtcctgagcccggtgaagtggcgaggcaaatcacatggggaagcgtacagcctgaactgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctgggttcgccagcatgagcgggataccgggggcggtgatggagggctcaccaccgctgaacgtcagcgtctgaaagagccggagcgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccgctatgcagcgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttacgtcagcacatggcggggcttcgtctatgtggcgttcatcattgatgtgtttgccggatacatcgtggggtggcgggtctcatcgtccatggaaacgacattcgtgctggatgcactggagcaggcgttatgggcccgtcgaccgtccggcacggtccatcacagtgataaaggttctcagtatgtatcgctggtctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactaacgtgggtggactggtataacaatcgacgattgctggaaaggctgggccacatccctccggcagaagcagaaaaagcttattatgcttccatcggaaacgatgatctggcagcctgagttcacagataaaacactctccaggaaaaccggggcggttcacgtcagtatcagaccatattaattgctgaaactgataaacatcaaaccttatagaagggtgaatgctgaaagggggctatggtgatcgacgtgatgacaacgacaggtaagaccgtgacctgataaacctgaattgtgtcctagacataaagtccgtgaagggaataaggctcaggtcagcgaatcttatagtggcccgcagctctgactgcaataaggccggatacagagcagcaactactcgtcgatgtcagaacaacggaagccttgcaaacggggatgcgttcatacaggaacaatgataccgttaaaaaaaaacattacgctaataatgttcaccctgtcattactgacaggaaatcctgctatagcgtatgaaacagataaagtatataaaataaccgttctgcatacaaatgaccaccatggacacttttggcgtaacaatcatggtgagtacgggttatcctcccaaaaaactctggtggacaatatccggcagaaagtaataaataatggcggaagtgttctattattatctggtggtgatattaacaccggtgtacctgaatcagaccttcagaaggctgaacccgatattcgtggaatgaatctaattggttatgatgcaatggccgtcggtaatcatgaatttgataatcctctaaatatattacgtcagcaggaaaaatgggccacatttcctttcctttctgctaacatatatcaaaaaagtacagggaggcgtttattcagtccatggaaaattttcatccgtcagaatttgaaaattgcagtcattggcttgacgacagatgatactgcgaaaacaggaaattctgaatattttactgatattgagttccgtcaacctgctgctgaggcgaggagtgtcattgatgaacttaatcagcaggaaaagccagatattattattgcggcaacacatatgggtcactatgacaatggcgagtcaggttcgaatgctcctggtgatgttgaaatggctcgcagtttgccgactggctcattagcaatgattgtgggaggacattcacaagctcctgtctgcatggccagcgataataaaaaacagtggaattatattccggggacaacctgtgtaccagataaacaaaatggcatctggattgtacaagcgcatgagtggggaaaatatgtcggtcaggctgattttgaattctgtaacggtacaatgaaactggttaattatcagttacacccagttaatctcaaaatgagaattaccagagaagatggaaaaacggaattttctttttacacccccgaaattactgaagatccacagatgttatccttactgacaccattccagaataaaggcaaagcacaactggatgtgaaggttggggttgtgaacggacgtctggaaggggacagaagtaaagttcgttttgttcagaccagtatgggccatctgattctgagcgctctgacagaacgtattgacgcagattttgctgttgtcagtggtggggaaattcgagattccatagagagtggtaacatcacatacaaagatatactgaaagttcagccatttggtaatacggtagtaagtattgatttgacggggaaagaagtagctgactacctagctacagtggcacagatgaaaccggattccggagcctacccacaatttttgaataccagctttgtagtcaaaaaaggaaaaatcgaaatgctaaaaataaaaggtaaatcggttgaccttaacaaaaaatatcgtatgacaacatttagctttaatgctactggtggggatggctatccacgtattgataatagacccggatacataaataccggatttattgatgctgaagtacttatcgaatatatccggaaacattcaccgctggatgctgcttcatatgaaccaaaaggtgaagtcagttggcagtgataacgtaattgacgatcatcacgtgttttttgctgacagtcgctgtgactttgtgaaagtagtctctgcgtatgtttgcgatatgggaatgcagttgctgtattttgtgtttctgcttctgccagttgttgctgaatttaaccttgcggcttaactgatgttggagcgctgccagcttcttcgtcaatttcgctgattaaagtttattcattatggcatgatctgcgtaagcggctcgtcagaaccatattgatatttactaagagctcagatcaactttccagggcaacagatcgcgtacccggtttgccggtcagtcctggatatgctcaatgacgtaacgcagccatttttctggctccacattgttcagacggcatgtgccgatcagcgagtacaacaccgccgcatgttcgccaccgctatcggaaccccgccggagagagtttcactctccggctgctcacggaaccgtacgtgacactctcgcgtcatacggctcttgatcactcattcgatgcacgtagtaaataccagtgggcaaatagcttcggatactgtttccttaccagcgccagctttcgctgagccttccggttcgaaagtctgtatttagactgcatccacttaagcaaacgtgactgcattgcactccacagtcgatagctgaagtttctggaccagaactttccatagtactcaatccagcctctcactatcgcattgtagcgcctcgcaaaatccagcaaactctcagctgttgagcgatgtatacgccacttcttgattgtttctgttattttgcacattgctgcatttgatgcacccggcatacattttctgtacaattcgcctttgaaattcttcagagtacgcactttgaagtcatatccgagagtggcatacaacatcatcggcgtacctttcgaagggaacgccgggaaactgacgttgcatccacatatcaaaggcatagtgcaggaacagatttgagagcaggggggagattacgccgccctgcggcgttcctcgaccccgtgccagcattgctccatccggcatttgcaccggtgccttcagcctgcgctcaatgtacatcaccacccagcgtgcctgagtatgatgctgcactgtcttcagtagcaggtcatgatcgatatcatcaaagaagcctttaatatcgacttccaccacccagtcaaacttccagcagcgtttcctcgcctgcgcaatcgcctggtgtgcggatttacccggtcgataaccatacgagtctgcatggaacaggggttccagtaccggctcgagtatctgcttaacgaccatctgggcgatccggtccgacacggccggaataccgagcggacgtacaccaccgtcagctttgggaatgtccacacgccttaccgcctgcggcatataactgccggaagccattctgttccacagtttgtagagattgtctgtaacattctcgtcaaacccggccagtgtctgcccgtcaatgcctgccgccccacggttggcttttactcgtttataagcttcccatacctgtcgtttacttacaggaaatggctttgccgattttacagcagtcctcccatcggcattgtcgcccgtggttgccgccgcaccatcagcacaatggggcaagccctttgctccggacccattacggtccttcaccgctactacggtttactccgtccctgtaccatttttcagcgttccccagaagctttccatcggagcgttgtcgtaacagttacctttacgcgacattgatgttttcagaccaaactgctcctgtatgacccggtaatcgtatgcgcagtactgtgaacctcgatcagagtggtggattagcccggcaggtgggcgctggctcctgagcaccataaacagggctttacccgtaaatattggctccttctgatgccattctatttcaggaaggagtgtccgttaaactcaggctacctcaaaaagttatcggtgcgtttatcgaaaaacatatgttctactaattggagtcattgtctgtaaaagcaactcaaaaatacaagttgcttattccccttgttggtaagaacttaattctaactgtttgttctgggtgttttaaacgtcctcctttttatgcttgttcataacggatatttaataggtaacctttgttttagcatcttctgatttatttaaattatgtgatagcacacacaattttattatccagtactttatgctcttaataaaataattataaatatgtatcctctataaggagatgttatatgaaaagacagctttttactcttagtattgtcggggtattttctttaaatacctttgcatcattccctccgggaaatgatgtgacaacaaaacctgacctttactacctgacaaacgataatgctattgacagtctggcattattaccgcctccaccacaaatcggaagtattgccttcctgaatgaccaggccatgtatgaaaaggggcgtttattgcgaaatactgaaagagggaagctggcagctgaggatgccaatctcagtagtggtggcgtggcaaatgtattttctgctgcttttggttctccgataacggctaaagattcaccagaattgcataaattactgacaaatatgattgaggatgccggagacctggcaacgcgttcagcaaaagaatattatatgcgtattcgaccttttgctttttatggtgtttctacgtgtaatacaaaagaacaggatacattatccagaaatggctcttatccatcaggtcatacatcgattggttgggcaacagcacttgtattgtccgaaataaatccggcacgccaggataccattctgaaacggggttatgaactgggggacagcagggttatttgcggttatcactggcaaagtgatgttgacgcagcacgtattgttggctctgctattgtagcaacactgcactcaaatcctgtgttccaggcacaattacaaaaagcgaaagatgaattcgctaacaatcagaaaaaataatgcttttagccagtacgccttataaccccgaccttcagggctaatgccagtcagttaagcaactgactggctctttttcagggctgtggggtatttccagggcctctcctttaccactctcggaaaggccctttcccttcttgtcggtaatttcactaggctgtgtcccttaattacgtaagcgttgataaaagagtcggatgcagcccagtttcactatcgccaggtaatttctcgccgttttgtcgtaacgcgtggcgatgcggcgatattctttcagccgcccaaagcaccgttcaacgacattacgattgcagtacgcatcacgatcaagctgtgcacgtccatccgatgccattttctcatttgactttcgggggattactgcctttataccgttatttttcagctcgttgcgcaatgcgcgccctgaatacgctttatcagccagtaccgcatgtccacggcgtttcatgctgccgttctgacgctgaacgccaatcccgtccagaagtcgttgcgcgaactggctttcatgagcttgtccggggcttagcacgatatttaacgggaggccacttccgtctgttgccagatggattttggtgccaaaaccgccgcgagagcgacccggcccattatctccgtcgatatcgggatgtttttttgagcaccggcggcacatttcagcgcccggatattactgccatccagcgcggtggcagaccagtcaataaagccgtttgcatcaagtagcgaaagcaacctgttgaaaataatattaatcacgcctgactttgaccatcggttaaagcggttataaacagttttccatgccccatatcgttcgggtaaatcgcgccatggtgcactggaacataacacccagaacatgccattgatgattttacggtgctcagcccatgggcgtccggcccgtggtgtggcgggttcaggaggtaacaggggcttgatgatggtccatgcctcatcgggaaggtcgtagcgagccatagttcaatatgttgtgtaaacagacagttactataactcagatgattaagggacacagcctagttcagcatcccggttatctgaaagaagacctattttctcttttgcacaacagtacagtgcgtcgaggcggcggtaatactccattagctttgcttttccaatcccatcctgctgttcagtccacacctgtagattggaaatcactgcaagagcttcagctaacatgtctgtactttcacgtaataaatcatgcggcgtttttacaattgaggtgatcacaaatggcagtttcttttgttcagtaatatactgataaaaagctgcaatagcctgagtttgactgatattcatcagcttcagcacttcatctgcttggttctttatatcatcatcaatacgtgcgttaatggtcgccatcgtcatctctctgttattgtcacacactgacaataatgcatatttgcattacaagcaacgagataatgcaaaattattgcattcctgtctgttgcattttttatgataatctgaatattcgtaaaaatctgattttttagtatgtataaaagaagagcaggtaattgactgaacctgctcttcttttattatttttttaacatagaaagattgcgtctggtttgttcttcgaaatcatcttttgaagtgatgctctctgatttgttttctgaagatgcctctatgatgttttttaacacacttatatcaattgatgtggatgtgtatcctgttgtttgttctataagtttcaccagattttctgcagtgattttctcactgaaaaaaacgctgattagcgttaacagtcggggggcaacagaataaagagctgctccgcaaataagggattgtctgtagaaatctccccgcatttgtactgggagagagtctattgtttgttgtgtcaggttgtcctgcggataaagtgccgggtgcaggtatgccacaactttctttcttttttttggatcactgctttccattacgcatgcaccattgctttcaccaatgcaaactgaggttcatccaccttgttcactttcagattcgggaaatattgctttatgtgagggtaaataagctcggctcctccgccagtgagatagattcggttcattcctgagaatgttgaaatttcctgcctgatgctttctgccagagatttcacttctctgtctattacatgagaaatgttttttatttcagctacatcatttattaatgtctggagatattcattatcgtgtctgttttttattaactcatcagcaataaaataattacatggtgtggaggctttcgtcagcgcattcatgacggtatgagtgatgcgggatgtcccgatttctgaatagccacggatttcagaaatgccttcaaatgcaccgagaattaaaccacaatccagagtggttcctccaagatcgataatcaggctgcgttcaagtttgtttactttatctttttttagtgattcaaatgcagctggcaaagattcaggcattacattaacttttttaattttaaatgtttcccctttattcagagatatctcacggagaacatttgccttttttctttctattctttcttcatttggttgattgtcattatcaaagaattcggtcacaggtaatgttactgtcagttctacatcctgtggctgaaggccggatgtcagcagtgcatgatgtatggcaagcagattggtggtgctgtattgataactgacatgtgttgtacctatgacagcagtgcttcccaaatcataggtgtattttttttcatccacgacgtaattgtaaactttgccggcattaaacagtcccgggttccagccttctttaaagctgtttcctgacagactggttcttacctcgccatcttcaagccaggccagttttacgttagttgaaccatcatcgcatgatacttttagcattctttttgcctcgttttgagtttgtgtttatctcaaattgagcatcctttatgtcggtgcatctttttgagttttttattgtttcttattgtgactcattttgagtctatgtcaaacggtgttgctcttttagagtctctttatgttcttgttgtggttcattttgagttcttattggtttctcattttgcgccacgaactgagacggatactatttaaccaggccgtgccggcacgttaaccgggctgcatccgatgcaagtgtgtcgctgtcgccggcctcctcacccggtcacgtttcgtcattcctcctccacgcgctgcggcttcggggccgcacctgcattcgtatgcggtcgcccggttacaggtgcggcacggcctgatggaggccgcatgtgagaggagaattcccatgccaaactggtgctcgaatcgtatgtattttcctggtgagccggcacagatcgctgagattaaacgactggccagcggtgcagtcacaccgctttatcgccgcgccacaaatgaaggtattcagctgtttctggccggaagtgccggacttctgcagatcactgaaaatatccgctctgaacagtgccccggagtgacggctgccggacgtggtgctgtatcgacggaaaatatcgcgttcacccgctggctgacacacctgcagaacggtgtgttgctggatgaacaaaactgcctgatgctgcatgaactctggttacagagcggtactggccagcgtcgttgggaaggattaccggatgatgccagggaaaccatcactgtgcatttcaccgcaaaaagaggtgactggtgtgacatatggggtaacgaggatgtatcggtgtggtggaaccgtctgtgtgacaacgtagtgccggaaaaaaccatgccgtttgacctgctgacggttctgccgacccgcctggatgttgaagtgaacggctttaatggtggtgttctgaacggtgttccttctgcatatcactggtatacggaacggtatggcgtgaagtggccttgtggatatgacctgaatatcagcagtcagggagaaaacttcattcaggtggatttcgacactccgtggtgtcagccggaaagcgacgttattgcagaattaagccgccgtttcagctgcacgctggagcactggtatgccgaacagggctgtgatttctgtggctggcagttgtatgagcgtggagagctcgtcaatgtgctgtggggggaacttgaatggtcttccccgacagatgacgatgagcagccggaagtcaccggacctgcgtggatagtcgacaatgtggcgcattatggcggatgaagtatgacggagacgggcgggcaaccgcccgtttcttttccgacaaaggatgtcgccgtgctcctctttttactgcgccggctgacgcggcgcggcataaacgctgcctgtggtcagtgtcccgcgtccggcgggcacgggacgggcgcttttaccgctcccggctggtgtcggtgacagtgtacgccagcccgtcgcccttttctgatgaacgcccttcaagccgctttcgcggcataaccttgctgtcaaaaagacgacggctgcggtattccacggtcggcctgacccgttaccggaagcgatgaacagcccacaggcagcggggaacgggcaccacaggggtgccctctgtaagagaaggatctgttatgtcccgttttgtcctcggtaactgcatcgatgttatggcccgtattcctgataacgccattgatttcatcctcaccgatccgccatatctcgtcggttttcgtgaccgtcaggggcgtaccattgctggtgataaaactgatgaatggctgcaaccggcctgtaatgaaatgtaccgcgtactcaaaaaagacgcgctgatggtgagcttctatggctggaaccgcgtcgatcgctttatgtctgcctggaaaaatgcgggattcagcgttgttggtcacctggtcttcaccaaaaactacacatcgaaggccgcatatgtgggctatcgccacgaatgcgcctacatcctggcaaaaggccgtccacgtctgccacaaaacccgctgccggacgtgttgggctggaaatattcgggcaaccgccatcacccgacggaaaagcccgttaccagcctgcaaccgctgattgagagcttcacacacccgaatgcgatagtgctggacccgtttgcaggcagcggttcaacctgcgtcgccgccctccagtccggacgccggtatatcggtatcgagctgcttgagcagtatcaccgtgccggacagcaacgactggctgccgtacagcgggccatgcagcagggggccgcgaatgatgactggtttatgccggaggctgcgtaaatgaactatgccggacacgaaaaacttcgcgccgaagtggcggaggtggccaatgccatgtgcgacctgcgtacaaccatgaatgagatggagcggcggtacagctttaatgctgacaccctgccggaacgtctggtgcgtcagacgttgtttcgcgcaaaccgcctcttgatggaggcatataccgaaattctggaactggattcctgcttcaaagattgaggggagagagtatgtacggaacatgcgaaacgctatgccgggcgctggcagcaaagtattcgggagacacgccgctgatgctggttatctggtccccggaagagattcaggccctcgctgacggaatggatatttccctgtccgatcatgaaatcaggaccgtcctggcgcacctggaggacatcccggaagactagcggattgagtccggtatttcttccgccgcggcgatggagattatcagcaacgtgcgcgaaaaccgccaggtgaccgtccctgctgaactgctggagaccctgactcagatcgctgaacaggcactgtggaaacgtgaatgggctgcccgggatcacggtttccccctcccggaatacgttacccgccgacaggcgatggttgatcaggcccgcagcctgctgaaaaacaacacacacgaaaacgactgatgttatcgccgcctgtgggcggcgatacagggagttcatgaattatgaatgaaacgctgaatgctctgatttgtcgtcacgcccgtaacctgctgctggcgcagggctggccggaagagacggatgttgaccaatgtaacccgaactatccgggctggatcagcatttacgtgcggctggatgcgccccggctggcgacgttactcgttaaccgccacgatggcgtgctgccgccgcacctggcctccgccattcagaaactgaccggaaccggagcggaacttgttctgtccggcagtcagtggcagtcgctgccggtacttccggcggacggaacgcaggtgtctttcccgtatgccggtgaatggctgaccgaagacgaaatcagggcagttcttgatgcggtgcgcgatgcagtatgcagtgtcagttgccggggggcagaagatgcgcggcgtatccgggcggcgctgaccacaagcggtcagacgttgctgacccgccagacgcgccgctttcgcctggtcgtgaaggaaagcgatcacccctgctggctcgatgaagacgatgaaaacctgcccgtggtgctcgatgccatcctgaaccggggcgcacgtttttcggcggtggaaatgtatctggtcagcgattgtattgagcatatcctgtccagtgggctggcctgcgatgtgctgcgtataccggatgaaccgccccgccggtggtttgaccgtggtgttctgcgggaagttgtccgggaagcccgggccgaaatccgcagcatggcggatgccctggcaaaaatccggaaatgatgacgatggcggggaaaatctatggtcacccccgtttttgcaacactgatttttgattaatggtgggcttgcttaaatctatccggcgtctctgtgggcaagggatgcccgcgcctcgatgagttccgcacctgataatcctaaaaatcccctcggcttcagtgagccattttcccctgttaggtttttaatcaggtcgatttgccgttcatgtcatcaataatcaatcttcgcaaaaccagacggtaacttgtatcttattgtttgcaataagctaattgagttttgtcagcatctatatatcaggcctgatattctttttgctgagtagtgattgcctaggcaattcgggccagtttatttgccagagcgcaggcaaccacattcgaatgcttcttgttgagttgctcccgaacccactcagcaagttttccatgctggcgttcaagctgcatcatgaatgagcgggcacactgaaccagtaaccggcgtaaatttttatcacctcgcttactgatacccaacagagtcgattttcctccagtgctatactgccggggaacgagccctgtggaagccgcaaaatctctgctgcatgaaaactgtttcccgtcaccaagttgcgacgatagtaagctggcagtaatcggcccaacaccaggaattgtcataatgcgctgagcggtatcatcagcgttgattgactgacttaattctgattccagctctgctatttgctcaacaaggtaaaggtagtgggtatgcaacctcaccaaaaggcggctcagatattcggggatttcgtgttcagccaatacgagagacaaccgttttattacggcatcccctgtcggcaggctgattccaaattccagcaggaaaccgtggatctggttggttgttttcaccttatctctgatgagcgattctctgacccggtgtaatgcccttattgcttgctgggtctcagttcttggctggacaaaacgcattgatggtcgtgaagccgcttcacatatggcttctgcatcaacgtaagcgccccgagaagtacgtagcgtaaggattattttacagacgagaagttccagggcagcagttcatgcacttggttcgacggccagtcattgagcttctcgatcacttcgcgcaaccagtcctccggctccacttcgttctgtttgcaggtgaccagcagactgtagatgatcgccgcactttctcctcccttgtctgagccgaaaaagagataattttttcttccaaccgccaccgatcgtaacgcgttttcaccgatgttgttgtctatttccacccagccgtcacgacagaactcgttcagcgcattccagtgattcaggatatagtcgaacgccttcgccatctccgcatgtttcgacagcgttttcctctgcaactgtatccagtcgtacaacgactgcatcaactggacgcttctggcttttctgactgcaagccgttcctctgccggactgccacgtatctccgcttctatgtcgtataactctgctatccgtctgagcgcttcctgagtcatttctgtcggacggcgcacatcctcgtcatgggtttttcggcgggcgtgggccaggcacccggcttccttcacccggcccgtttcgtacagtacgttataacctgcataggcatcagcctgcagtacgccctgatactttgccaggtggagctgcggatgttctcctttgcgatctgccgaatacgcgaaccagacggctgccggcagggatgaacccgcattacgatcatccctgacgtatacccacagacgacccgttttcgtctttccgttccccggggccagtactttcaccggagtgtcatctgcgtgcacctttcctgcctccagaacatagtcattcagcgctatatacagaggacggagtttgtctgccatttctgatacccagcgcaccatggtattacggctcagctccacgccctgtcgcgcgtatatttctgactggcgatataaagggatatgttccatatatttgctgaccaggatccgtgcaagtaaccctgcactggcataaccgcgttcgatcggtttaggaggaagtggtgcctgaacgatgacatcacaccggctacaggccagtttgggacgtatggtttcgataactttaaaggcggtattaatgatatccagttgctctgagattgtttcccccatttctttcagaacacctccacaggccgggcaactggtttcagcaggcagaaggcgatgtgtctcccggggaagttctgccggcagcggttttcgtgaagattctcgtcccggggattcaggcttactggcgatcgggttttctgacgggggactggtgtcaggtgaatctgtgactgacgatgcatcttccagaagatttctggctgtgttcagccggttttccagttccgacagtcgtttttctgcctgtcggatctgattttcaagcttatgacgctttttctctgaactctggccgaacaacatacgacgcaacctgtcgagttgcgctttcagccgttcaatttcctgctcatagcccgcgacctgacaggcatactgtcgaagccgactctgttgcttacgcaacatggctttaagcagctcaatatcatcggggagttcattgttcattcccttgttttatcacgggttatatccggatgccaggccgttctgtccgtttgggatgttgccacgcgatcccctccagtagcatggataactgagctggcgtcaggtgcactttcccttcccgggtcaccggccagacgtttggcgaacaggcataacccgtcacgatcggcccacagtattttcaccattttgccactgcggccccggaagacgaagatatgcccggagaacgggtcatctttcagcgtgttctgcaccttcgaagccaggccattgaagccacaacgcatatctgtgatgccagcgatgatccagattttggtaccggtcggcagcgttatcatcggataccccctttcatttcgcggattagcgcccgtaacagttccggagtgagagggtcaaacagttttaccacacctgatttaagatgcagctcgcaccgtgggacgtttccgggagccccctcagggcgctcatcatgcttgttacgccagaagggatttgtaactggtctggtcggctccggcgtatcagtcagtgccaccgggacaggcatgcattcctgtatgtcatcatcgctcagtaagccgtcctcgtactggcttttccatttaaccagcaggttattattgatatcgtgttctctggcgatccgggcaacaacagccccaggctgtaatgcctgcttagccagacggaccttaaattcacggctatagctggttcgccgttcttttcgccatgagccttctctgatttgaggctctgttaattccttctttctgttggcataaaggatggcgtcaagttgagcgaatgaaactgaatcgggcaatggccatgcgataccggatgcaagaaatcgctgaaaaagcgtatgtattgtggaatgactgagacccagacgctgagcgatggcccggatggtcagtttatcttcaaatcttaaacgcagggcatcaggcaaataagaacggaagcagggaatatcttttgttgtctgggaattcatcgttcgtgtccatcaatatagatgggcgcgattgttgccagacaggacaattttcacaagacgtcgctgatggggcgcttaccgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtcaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcgttctggcgcatgagccggtaaacacgtttggcattgatcgcaggcataccatcaagttctgcctgtctgcgaagcagcgcccatacccgacgataaccatacgtgggcagctctccgataacatggtgtataccgagaagcacatccgtatcatcagtgtgactactgcgggggccatccatccagtcatcggttcgtctgagaatgacgtgcaactgcgcacgcgacacccggagcaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggccacagcagtaagacttccttcctggtattgcttacgccagagaaatagctggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttaaataagtgatactggttgtctggagattcagggggccagtctacccagcaagcgctgtaactcttttatttgttttatagcggcagccagttctgaggcaggaacgacatcctctccggcagcaacagcagtgagacttccttccagatattattttttccacttaagcaacaggctgggctgaataccatgcaaacgcgccacatgggacaccgtcatgccaggctccattgtctgctgaataatggcaattttttcctgaggagttttacgtttacgaagctccagccccagcaaagttccagtcatctcaaaattagaactagtgttagacatatatccaagcctatctcttattttaagatacatccactgtctggcgtttcaaggggccggctcaaatctatgtacaggctctcagcatcagcaaagcctcttacttttccaactactactgttagcatagtgatcaaattcctgatcagatacatgaattacctgaaccgaactattttcatctacaaatgcatctggcgatttttctacaggatcataaagattaaatccctttcctgtttgaacatccaaaaacataattttttcaccatcgttaaatccagctatccaatgagtggcctgttcaatagaaatcattactacacttccttttgaagtattttgtaaaatattttctgcaatacgctcacgaaatttactataagtttcattaggatgtgacactatgccttcactatcaatttgctctaaatgcctatgaaaaaatccggtcatatactctgatatttcattaggtacgggagcctctcttactccataccctaacatagccatacaagcatgaagcgcacaccctgaacagttaccatccccaccagacggatttatcattttctgtaaagtcgctgccaattcagaatctttatccatatcaccaagacttttagagtttaaagattccagcaattttttaacatttacatttccctcctctgtatgtgcctcatatccagcagttccctgtaacgacaccccattaatcatattgtatcctgacagtatatatactcactatattttcttcataacaaatatccctctgatatgacaacaaaaaacggagccggattcctgtttttgtgaactgcagctattcgtgtctaaaaagtgatccacttaccaccaacggcctaatatatacagaacggagtaaacaggactaacagttcccgacaggtctcatcattccgtggcccgaaagtgtaagccaacacaccgccagttttagtgttgtacgaataccagagccagtgttgttgcagccttgctgccaacgaagcgccactgctcatcaagttcacagataagggcaacatcagcgtgagcgactggcgcagatgttatccgccggggcgggagctttttaatgtccgtatgacggtattgatgccgattttcagtgtcctggcggtatcacggccccctgcgccgttatgtgccatttcaacgatctgctccttaacgccgggttttctggcttcataagagtaagtgagctggaaaacacgtttacatgagcgacaacggaaacgctcatgccgggaacaactacggccatgtcgataaacttcatcggaatgacagcgcggacaatgaacagtaacggtagccatggaaaaccttaaataccagtagattaccagaaacttctgtcgattgaagacatcacccgaagtttgaattcattcgaatactttttacgaggttcttttcgccagtcctgtaattcgtaagcgccccatcagcgacgtcttgtgaaaattgtcctgtctggcaacaatcgcgcccatctatattgatggacacgaacgatgaattcccagacaacaaaagatattccctgcttccgttcttatttgcctgatgccctgcgtttaagatttgaagataaactgaccatccgggccatcgctcagcgtctgggtctcagtcattccacaatacatacgctttttcagcgatttcttgcatccggtatcgcatggccattgcccgattcagtttcattcgctcaacttgacgccatcctttatgccaacagaaagaaggaattaacagagcctcaaatcagagaaggctcatggcgaaaagaacggcgaaccagctatagccgtgaatttaaggtccgtctggctaagcaggcgttacagcctggggctgttgttgcccggatcgccagagaacacgatatcaatgataacctgctgtttaaatggaaaagccagtacgaggacggcttactgagcgatgatgacatacaggaatgcatgcctgtcccggtggcactgactgatacgccggagccgaccagaccagttacaaatcccttctggcgtaacaagcatgatgagcgccctgagggggctcccggaaacgtcccacggtgcgagctgcatcttaaatcaggtgtggtaaaactgtttgaccctctcactccggaactgttacgggcgctaatccgcgaaatgaaagggggtatccgatgataacgctgccgaccggtaccaaaatctggatcatcgctggcatcacagatatgcgttgtggcttcaatggcctggcttcgaaggtgcagaacacgctgaaagatgacccgttctccgggcatatcttcgtcttccggggccgcagtggcaaaatggtgaaaatactgtgggccgatcgtgacgggttatgcctgttcgccaaacgcctggaacggggccgcttcgtctggccggtgacccgggaagggaaagtgcacctgacgccggctcagttatccatgctactggaggggatcgcgtggccacatcccaaacggacagaacggcctggtatccggatataacccgtgataaaacaagggaatgaacaatgaactccccgatgatattgagctgcttaaagccatgttgcgtaagcaacagagtcggcttcgacagtatgcctgtcaggtcgcgggctatgagcaggaaattgaacggctgaaagcgcaactcgacaggttgcgtcgtatgttgttcggccagagttcagagaaaaagcgtcataagcttgaaaatcagatccgacaggcagaaaaacgactgtcggaactggaaaaccggctgaacacagccagaaatcttctggaagatgcatcgtcagtcacagattcacctgacaccagtcccccgtcagaaaacccgatcgccagtaagcctgaattcccgggacgaaaatcttcacgaaaaccgctgccggcagaacttccccgggagacacatcgccttctgcctgctgaaaccagttgcccggcctgtggaggtgttctgaaagaaatgggggaaacaatctcagagcaactggatatcattaataccgcctttaaagttatcgaaaccatacgtcccaaactggcctgtagccggtgtgatgtcatcgttcaggcaccacttccccctaaaccgatcgaacgcggttatgccagtgcagggttacttgcacggatcctggtcagcaaatatatggaacatatccctttatatcgccagtcagaaatatacgcgcgacagggcgtggagctgagccgtaataccatggtgcgctgggtatcagaaatggcagacaaactccgtcctctgtatatagcgctgaatgactatgttctggaggcaggaaaggtgcacgcagatgacactccggtgaaagtactggccccggggaacggaaagacgaaaacgggtcgtctgtgggtatacgtcagggatgatcgtaatgcgggttcatccctgccggcagccgtctggttcgcgtattcggcagatcgcaaaggagaacatccgcagctccacctggcaaagtatcagggcgtactgcaggctgatgcctatgcaggttataacgtactgtacgaaacgggccgggtgaaggaagccgggtgcctggcccacgcccgccgaaaaatccatgacgaggatgtgcgccgtccgacagaaatgactcaggaagcgctcagacggatagcagagttatacgacatagaagcggagatacgtggcagtccggcagaggaacggcttgcagtcagaaaagccagaagcgtccagttgatgcagtcgttgtacgactggatacagttgcagaggaaaacgctgtcgaaacatgcggagatggcgaaggcgttcgactatatcctgaatcactggaatgcgctgaacgagttctgtcgtgacggctgggtggaaatagacaacaacatcggtgaaaacgcgttacgatcggtggcggttggaagaaaaaattatctctttttcggctcagacaagggaggagaaagtgcggcgatcatctacagtctgctggtcacctgcaaacagaacgaagtggagccggaggactggttgcgcgaagtgatcgagaagctcaatgactggccgtcgaaccaagtgcatgaactgctgccctggaacttctcgtctgtaaaataatccttacgctacgtacttctcggggcgcttaccatacggtggtcggtttacgcttaccgcaggacaggtggtaactgaaaaatagtttgctgaggcgactggaaacagaagggcaagatcgattccgacagcagtgatggtcagctacctcatcgataactttgcaacagtgcccttcttgaagcatcatgcttcatgaagaaaaactggcacgtcatcaacgtaaacaggcgatgtatacccgaatggcagccttcccggcggtgaaaacgttcgaagagtatgacttcacgttcgccaccggagcaccgcagaagcagctccagtcgttacgctcactcagcttcatagagcgcaatgaaaacatagttttacaggggacatctgacatcacaaatccccgggtggggatttgtgtataagagacagcccatggaggaaggggatatatcgcagctctgacgactcactccttatttacccgggaaatacttctccagcaatgcatacaggatggcagcggtttcagcatccattatgccgtcataatttttctgccggaaatgaagctgaaaagcgcggacaagcgccttatatccgtcatccgtctccacaccagaaatactgtatccataggtcttcagccgtgacacgatatcaaccttatccggaatgccctgcgattcaaaaaataaatatttagtcagtaattttatgtttttcctgaaaaaattactctttttcgaactccagtgagcgttcacgactcatcagtgtgaaaatgatggcaaaaacagcagacagtatcagtacgataaatgtggccccccatcccagataatcgacaacaagtcccattcccagtgtcgcaacaattgagccgaagatataggaaaatgtgcctgacagccctaacagaataagtttacgcgtaaatcgcccggaatccagaagagcattaagtatcacataaacaggttccataccagtcctgaccgcatcaggacgccagtaaataaaatctcgtagtccaccggcatcagagacaagagtaatcgtcgttaccggtatttcgactggtttgtactggtgtgagcggacaaaactactgtacgtctctcatacacgctcgtaagcggccctcacggcccgctaacgcggagatacgccccgactgcgggtaaacccttgtcgggaccactccgaccgcgcacagaggcattttcatcgctgacaggccgcatggcctcgcagagccggagggggactggtgatattcggacgaccgtaccggcttgcgccgggcttcggcggttttacacctgtgctacatgtaaccaccgtatgccgccttatatgcgctgactcgcattatttgccttgttccgtctgaaagtaatcactatgattaaatatgattaacaactaatcgggtatgcaaatgaaaaacaataccgcacaagcaacaaaagtaattaccgcgcatgtgccattacctatggctgataaagtcgaccagatggccgccagactggaacgctcccggggctgggttatcaaacaggcgctttctgcatggcttgcccaagaggaggagcgtaatcgcctgacgctggaagccctggacgatgtgacatccggacaggttatcgaccatcaggctgtacagtcctgggcggacagcctcagtactgaccatctgttaccggtgccacgctgatggaactgaagtggaccagtaaggcactttctgatttggcgcggttatatgattttctggtgctggccagtaaacctgctgccgccagaacggtgcagtccctgacacaggcgccggtcattctgttaactcatccacgtatgggagaacagttgtttcagtttgaacccagggaggtcagacggatttttactggcgagtacgaaatccgttacgaacttactggccagactatttatgtattgcgcctgtggcacacacgagagaacaggtagattgggtgtggaggcaactttaacatagcctgcaggtattaattctggagcattgttatcaggccagatattttgcattccattaaataatcttgtaggagataaaataaattacgatgaaataacgaaaattaccgctcgtgactggcggcaatatcgcgctccgggctggcaaataacccatcagaaacgttattgccagacattgcgggtaatgactccaacttactgatagtgttttatgttcagataatgcccgatgaccttgtcatgcagctccaccgattttgagaacgacagtgacttccgtaccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccaatgttcgtccatttcagcgcagacaatcacatcactgcccggttgtatgcgcgaggttaccgactgcggcctgagttttttaagtgacgtaaaaccgtgttgaggccaacgcccataatgcgtgcgctggcgcgacatccgacgccattcatggccatatcaatgattttctggtgcgtatcgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccctgcccctgtatcgccagcagcacattttctcccgaatgggtgtggagctccccgtcagtacaatggcggatatggtcggtgttgccggagctgcactggccccgctggcgaaactgctacgccatgagcttctgacacgggatgttattcatgcagatgaaacgtccctgaggctccttgatacccggaaaggcggtaaatcctgctccggctggctgtgtgcttacgtcagcggtgaaagaagcggtccgccggtcgtctgttttgactcgcagaccggacgggccctcagataccctgagacctggctgcagtgctggtgtggcagtacgctggtgagtgacggatacagcgtgtacaaatctctggcggataatcaccccggcatcacatcagcctgttgctggagtcacgcagggcgcggcttcgcaaatctgtataaggccagcagggagccccgtgcaggcgtggagctgagaaaaatcgcgggtctttaccgcattgagaaactcatccgtgagcgccctgtggaaaaaatacggcagtggcgataacggtactcccggccgatagtgaatgacctgtttgcctggcttgaagagcaggagccgtgctgtccgcccgacgggccattaaataaggcgattaactatattctgaaccggcgcgatgaactgagctgcttcctgggtgacggagctgtgcccctggacaacaatatctgcgagcgtgccattcgcccggttgttatgggacggaaagcgtggctgttcgccggttcactgatggccggaaaccgggcggcacagataatgagccttctggaaacagcaaaacgtaatggtctggagccacatgcctggctgacggacgtcctgacgcgtctgccggaatggccggaggagcgactggcagagttgctgcctcttgagggatttaccttcaccgggtgagtgatacctgccgtcaggtgttcgtgaaccgggctataacctgcagtcggttgttgaacgcctgacaacaggaaatcagccaggccagcaaccacgcggactgacagagaatcagaacctgaatcagcctgaaatcatacccggggcagtacttcatcaccagtcaccaatacccgtgtcagtacttcgcggcctgacgcgatcacccgactcagtacttctgagcccgcctccggtaccattctctgtgggcccgtacacaacaacagaaaagggtgcccggcccggggcgcaaccgtattacacttccggaaaatcgttatacgcagaaaaatcggatcacgctgtgcctgctttcatgtaatttacttacggtgttataagtatgctaattatagtataaaaaaatcgcagcagaaaaaattgtattaaaaacttatagcgaattaatggtgtactttttatggatattgatggtttgtaccattaatatatactcatatacatatcataagtatgtttttgagggcttatcatgaagcagcgtattactgtcactatagacagtgacagctatcagttacttaaatccgcaaacgtgaatatctcaggcctggtaaatacggccatgcaaaaagaggcccgccgtctgcgtgcggaacgctggcaggctgaaaatcagcaggggatggctgagatcgcccgttttattgaaatgaacggctcttttgccgatgagaacagggactggtgaaatgcagtttaaggtttacgcctataaaagagagagtcgttatcgtctgtttgtggatgtacagagtgacattattgacacgcccggacgacggatggtgatccccctggccagtgcccgcctgctgtcagataaagtctcccgtgagctttacccggtggtgcatgtcggggatgaaagctggcgcatgatgaccactgatatggccagtgtgccgatcttcgttatcggggaagaagtggctgatctcagccaccgcgaaaatgacatcaaaaacgccattaacctgatgttctggggaatataaatgtcaggctagggtcaaaaatcgtggcgttgacaaaatggctgcgttacgtcattgagcatatccaggactggccggcaaaccgggtacgcgatctgttgccttggaaagttgatctgacctctcagtaaatatcaatacggttctgacgagccgcttaccgttcaaatatgaagtacgatgtttaactaaccgaaaaacaagaacaatacggtgcaaacaggccattcacggttaactgaaacagtatcgtttttttacagccaattttgtttatccttattataataaaaaagtgctgaagttcatttcatggaatgaacttcataaaaactcctacttatttcttttaacaaagccatttgtccaccggctttaactggatgcccatcatgttaccgataaataataacttttcattgccccaaaattctttttataacactatttccggtacatatgctgattacttttcagcatgggataaatgggaaaaacaagcgctccccggtgaagagcgtgatgaggctgtctcccgacttaaagaatgtcttatcaataattccgatgaacttcgactggaccgtttaaatctgtcctcgctacctgacaacttaccagctcagataacgctgctcaatgtatcatataatcaattaactaacctacctgaactgcctgttacgctaaaaaaattatattccgccagcaataaattatcagaattgcccgtgctacctcctgcgctggagtcacttcaggtacaacacaatgagctggaaaacctgccagctttacccgattcgttattgactatgaatatcagctataacgaaatagtctccttaccatcgctcccacaggctcttaaaaatctcagagcgacccgtaatttcctcactgagctaccagcattttctgagggaaataatcccgttgtcagagagtatttttttgatagaaatcagataagtcatatcccggaaagcattcttaatctgaggaatgaatgttcaatacatattagtgataacccattatcatcccatgctctgccagccctgcaaagattaacctcttcgccggactaccacggcccacggatttacttctccatgagtgacggacaacagaatacactccatcgccccctggctgatgccgtgacagcatggttcccggaaaacaaacaatctgatgtatcacagatatggcatgcttttgaacatgaagagcatgccaacaccttttccgcgttccttgaccgcctttccgataccgtctctgcacgcaatacctccggattccgtgaacaggtcgctgcatggctggaaaaactcagtgcctctgcggagcttcgacagcagtctttcgctgttgctgctgatgccactgagagctgtgaggaccgtgtcgcgctcacatggaacaatctccggaaaaccctcctggtccatcaggcatcagaaggccttttcgataatgataccggcgctctgctctccctgggcagggaaatgttccgcctcgaaattctggaggatattgcccgggataaagtcagaactctccattttgtggatgagatagaagtctacctggccttccagaccatgctcgcagagaaacttcagctctccactgccgtgaaggaaatgcgtttctatggcgtgtcgggagtgacagcaaatgacctccgcactgccgaagccatggtcagaagccgtgaagagaatgaatttacggactggttctccctctggggaccatggcatgctgtactgaagcgtacggaagctgaccgctgggcgcaggcagaagagcagaaatatgagatgctggagaatgagtaccctcagagggtggctgaccggctgaaagcatcaggtctgagcggtgatgcggatgcggagagggaagccggtgcacaggtgatgcgtgagactgaacagcagatttaccgtcagctgactgacgaggtactggccctgcgattgcctgaaaacggctcacaactgcaccattcataatcacatcgcataaaactgtcagcgccagtgataggacaggtgaaacctgtcaatacgtaccggcttacgccgggcttcggcggttttactcctctgccatatgcaacaacggagtgccgccttacatgccgctggcgcggcatatcctggtgacgatatctgaacagttatatactgtgtatatacgtggtaatgacgaggtggcaaatggcacaggttaatatgagtgtaagaatcgacgcagaactgaaggatgcttttatggccgctgcaaaaagcatggaccgtaatggctctcagttaatccgggattttatgcgccagaccgttgaacggcagcacaattcttggttccgtgactaggttgcggcaggccgtcagcaactcgaatgcggtgatgtgcttccccatgacatggtcgaatcctctgctgctgcatggcgggatgaaatgagcaggaagattgctgataaatgatggagatgttctggaccatgctggccatccaggacaggaagcgcattcgtagtacattgcggagcagaacctgatggccgccattgaaccggacgaacggattggttattcagccagcagcctggcagggcagccgtataaaggccgcaacggtcgtgtggaaggaacatctggaccacacaaggtagcgtgtaacgttattttgtgtgaaaatctcttgtgatttttaaatatcgtaacaaaggtatgacatgaaaataacatctaccattattcaaacaccttttccatttgagaataataattctcatgctggcatagtaacggagcccattctcggtaagttaataggtcaggggtcgacagcagaaatctttgaagatgtgaatgattcatctgctttgtataaaaagtatgatcttattggcaaccagtacaatgagattctggaaatggcttggcaagaatctgagctttttaatgctttttatggcgatgaagcatccgttgttatacagtatggcggagatgtgtacctccgaatgctgcgcgtgcctgggactccccttagtgacattgatacagctgatatccctgataatatagagagcctttatctacagttgatatgtaaattgaatgagttgagtataatccattacgatcttaatacaggtaatatgctgtatgataaagaaagtgaaagtttattcccaatagattttcgcaatatttatgctgaatattacgctgcaaccaaaaaagataaagagattatcgaccgacgattacaaatgcgtacaaatgatttttattcgttattaaacaggaaatatttatagacgtatttgttgatgctataagccagaggctcttctatgagaatatggggaccattccctcgcgatattaacgtaatatcttaattgtatgcaccgccagaatgcgttcagtgcgatcacggcagcagacaggtaaaaatagcaacaaaccacccgaaaaaccgccgcgatcgcgtatgataaattttaaccacatgcatacctgtgcaacaaggcgaatcacgcacggatttccagccagagacacctgaaacgtaaccggctcatttaaaccgtctggtctgttacctccggttccacaaaaataatgtccatcattttgaagtggacactatcgtatggaataccggacctgaatcactgaagctttacgccttcatttcgaagaacatttaccacgggttgtggccggatgtcgcctgggcgtaccaaaatcaactgtctgtggtatgttcgtgcgcttccgcaacgctggcctttcatggcctctgcccgcaggtatgtcggagcaggaacttgatgcccttctttacggaagtgcctccacagtacctgtcgtacttactgaaagcaccgttatgcccaaactcccggtggtaaaaaaacgtccccggcggcctaatgccgatcagttaaggatcagttgaccgatccagtggctgtgtaagaatccggaaacgctcacttgtttccggatttttttatgcacattggacaggctcttgatctggtatcccgttacgattctctgcgtaacccactgacttctctgggggattacctcgaccccgaactcatctctcgttgccttgccgaatcaggtactgtaacgctacgcaagcgccgtcttcccctcgaaatgatggtctggtgtattgttggcatggcgcttgagcgtaaagaacctcttcaccagattgtgaatcgcctggacatcatgctgccgggcaatcgccccttcgttgccccagtgccgttattcaggcccgccagcgcctgggaagtgaggctgtccgccgcgtgttcacgaaaacagcgcagctctggcataacgccacgccgcatccgcactggtgcggcctgaccctgctggccatcgatggtgtgttctggcgcacaccggatacaccagagaacgatgcagccttcccccgccagacacatgccgggaacccggcgctctacccgcaggtcaaaatggtctgccagatggaactgaccagccatctgctgacggctgcagccttcggcacgatgaagaacagcgaaaatgagcttgctgagcaacttatagaacaaaccggcgataacactctgacgttaatggataaaggttattactcactgggactgttaaatggctggagcctggcgggagaacaccgccactggatgatacctctcagaaagggagcgcaatatgaagagctcagaaaactgggtaaaggcgatcatctggtgaagctgaaaaccagcccgcaggcacgaaaaaagtggccgggactgggaaatgaagtgacagcccgcctgctgaccgtgacgcgcaaaggaaaagtctgccatctgctgacgtcgatgacggacgccatgcgcttccccggaggagaaatggcggatctgtacagtaatcgctgggaaatcgaactgggatacagggagataaaacagacgatgcaactgagcaggctgacgctgagaagtaaaaagccggagcttgtggagcaagagctgtggggtgtcttactggcttataatctggtgagatatcagatgattaaaatggcggaacatctgaaaggttactggccgaatcaactgagtttctcagaatcatgcggaatggtgatgagaatgctgatgacattgcagggcgcttcaccgggacgtataccggagctgatgcgcgatcttgcaagtatgggacaacttgtgaaattaccgacgagaaggggaagtgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctggggtcttcgccagcatgagcgggataccgggggcggtgatggagggctcaccaccgctgaacgtcagcgtctgaaagagccggagcgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccgctatgcagcgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtatgaccatcagccggaaagccgttgccgcaggcgaccgcgtaaaccgtcagttcgtggcagaacgacctgaccagctgtgggtggctgattttacttacgtcagcacatggcagggcttcgtctatgtggcgttcatcattgatgtgtttgccggatacatcgtggggtggcgggtctcatcgtccatggaaacgacattcgtgctggatgcactggagcaggcgttatgggcccgtcgaccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactcacgtgggtggactggtataataatcgacgattgctggaaaggctgggccacatccctccggcagaagcagaaaaagcttattatgcttccatcggaaacgatgatctggcagcctgagttcacagataaaacactctccaggaaacccggggcggttcaaagggccttcccgagagtggtaaaggagaggccctggaaataccccacagccccgaaaaagagccagtcagttgcttaactgactggcattaaggccgccggggacgtttttttaccaccgggagtttgggcataacggtgctttcagtaagtacgacaggtactgtggaggcacttccgtaaagaagggcatcaagctcctgctccgacatacctgcaggcaaaggccatgaaagccctgatttccggaagcgagcgaacagtccacaaactgttgaacgtggtgtcagcggcggacagggataagccctcgtcagcagttccgtcagcactgcgacagcgttctttacccggtcaaaacagcgttgcggtgcaccacgcctgacggatgaactgcgtgctcagggttaccactttaacgtaaaaaccgtggcggcaagcctgcgccgtcaggggctgagggcaaaggcctcccggaagttcagcccggtcagttaccgcgcacatggcctgcccgtgtcagaaaatctgctggagcaggatttttacgccagtggtccgaaccagaagtgggcgggagacatcacgtacttacgtacagatgaagttcggttacatcctgtcagcacggaacctcacgctttttgagcggcacgacggatcccccccacccagtatccgacagacttttcactgcgttcgtaaaaacccttcttccctcccagcatatccactaattccggtgacatatcctgcagataagtctgcaaatcatgccccagatcttccggtgactgcaactcataaaccgcgcgccacacatcacccttccttattttaagccccgggttaagaatatactgtccgtggttcagcctcagaaaaagcttttttccataaggatttttgctgttaacttcatgttgagagagctggctgctgatataactccttcgtttgcggcgttccggcagcaacgcttcaggaagatgaaccacacactctgccagtcgtgccgcactgaaggcttccgaaaaaaacagagcacttcccagatgcgtgtggaacagcgcctgcatcaggatcaccagaaacattgccatctgccggttgtccagtttgatgaggcgtccttccacctgcagtgacagactttcaggtttcagcagggtatacaactgcgcacttttctgttgcgcataacggggcgtactgaccgccgctgacagaacttgatgataagccgccagcccgtcattaccggtcagcaagggatctgcaccacgctccagcagtaactgaaccagtgcaatattacctgcccgggctgctgacatcagcggagtaagattaaacggcgaacggtgatcaacaccataacgttcaatatcccgcaacacggcaaccgggttattcattgagtatggccggaaatacttcagctccagtaactgcagagtcttcgttctgggctgccttgtgggcttaaaatcttcccggtacagtgcattatacagcgggaacagggaataaatcagactgtactccagcgcctgcagttgtatggttttatcggctgtacctgcgaggatatgctgtttccactgtcgtgcatcctctgcggtgataatctgccatggcatctcagatgtctgcaggatccggctacggatggtgtccgcctgctcctgcttcccctgtttttcaagcagatgtgcggttttctgccactcatcacggctggaaatctcttcctgcagattcagaggctcttcctgatgcgtgagcgcaagcagactccacagaggatgctccacctgctgttcaacaagatacacattgtgtttagcacgggtgagcgcaacatacagcgcgttggtaaaaaatttatagatttccgctgaacgatcctgcctgtcccgcggacgggaataacgggcctcgccctcaagatcagccggtgtaagaccctcgcaaatatcatcaaatgcctgccgggcagcgcttactatattgtaaaggatcaccgtttcgtattccagccccttaacctcctgaaccgaaaagaccagcggcgtactgaaccagcatcgcgcctgtgctttctgttccggatgcatcacaatgaccgctacacgattcgaaagtgaggttttggcattcagttcctgctttgtctcttccctatcgtccagcaaccggatggtcccttctgcctgaccgcagcttctgacaaaatggtgactttcccgatcaatagcactaaagcggacctgtttgagtctcagcaaccggttagccagtgcagtgacgtggtgcccgttacggtaattcgcctgcaggatattaacggttgtgtcgtttccctgttgctgccggaaaaagagacttttgagcgaactccatgagaaaaagctcggatgaactatctgattggcatcaccacagagtaaaaactgaccgggatgacgtagcgttttcagtaccagttgcagttgaacaggcgtcatatcctgaacttcatcaacaaaaatgacatcataacggggagttgccaacgaaagatactgatgactgagcagattactgtcatactgatgcgactgtttcagccatgcgatataacgttcaaacaggacatagaccgtcgggcggtcctccatgccatagagcgactgccgtatccccagtgacagatacgcctcccgggacagcggcccattcccggaggcaaccgcaccgatcacgcccctgaactcctcatacagggtatgggcagcccccagtgcggcgatagccctgttgcggggcagccagtcgctgaacgcactgaaagtcacctccctgccttccggaatgcgcagagtttccagaaattccgtcagcgaaagaaagtcaatattctgtacctcactcccttcccctgaagcgtcatagagagtacgcgctttttccaccagaaatgaggaaaggctgagatacagtatatcaccagcagcctgcttcattttttccagtaccagcgccgtcttaccacttcccgccgagccaacaatcaccagcggtagcgggtgttcgtacagtgcctgctgatcatcatcaaaggacagcattttatccaggcggtggaaacgcccatgagacggattgatatacgtcagcgcttcagtcgcgatatcaacaggatccggcactggttgttgttgtaagcgcccttcatcaatcaccacgtttctgcgaagaaaacgtgaagtgttataggcatgattgcgaatatattccagaacaaggcagatagtttcaccgtggtagcgatacagcgaaaacagtaatcggtcccggatactgagccgggcgcggtaaagattggtgtcaattttacgaacatcagcctgaacaaagttatcggtggcaatagcctgtgcaaattttttataacccgggatcgtgtcaggattcagagtatgataaagacagattttcatggctgccggtttccgtcgtgcaaaaaacatgctgattttacgaaggaatgccttactgaacaaccttgcccggaataccccccgaaatcagatggaacaatcagaaaaatgctctgcagttatggaataaagaaggtggggtggtacgccgggagggcgatccgctggaaatggcgcagtagctgcaggcctgtcatgatgcaggaatagaagttcgtgtacaggttaatgaaagcgtcaccccgtaaataaactctgcgctgaaattcctttttttcattggagtacctgtgttgttctgaggtgaacatatcacctctgttcaggtagccaaattcagtgtgccacctcaaggttcttagtgagtcgtttttaaaagatatgataatatatcattgtttatgaattgttgatgtttaatttagtaaattatatcaaatatgccatgggtttgctatgttattcatccagtatctggaaataaaatgcaccagctttattgggttttccttttgtctctgcttgctaggtgccagaaactttaaatgttaaacgaagggggcattttgttcaaagccaatcatgttccggtattaatgtatcatcatgtcagtcattgccccggactggttacactttctcccgtgacattccggaagcaaataaaatggttggctgaaaacaactggaaaacactgtcatcagatgaactggagtttttttatcggggcggaaaactcccccggaaaagcgttatgttgacatttgatgatggataccttgacaactggtttcaggtatatcctttattaaaagagtttaatctcaaagcacatatttttttaattaccggttttattgggaatggtccggttcgtcactctcctggaaaggaatattctcatcgcgattgcgaacatcaaatagcgacagggaatgctgataatgttatgcttcgctggtctgaagtaaacgaaatgttgcaatctggtctggtcgaatttcatgttcatacgcatactcatacacgctgggataaaaagttcagttcacgagaagaacagtgtaaacatcttcggcaggacttgttgagcgggagagaatatttgaaagaaatgacaggaaaatgcagtaaacatttgtgttggccggaaggttattataacaaggattatattcaggtcgctgaagaacttggattctattatttatatacaacagaaagaagaatgaatgctcctgctaaaggaactacacggataggaagaataagcaccaaagaacgggaaagttgcgcatggctgaaaagacgacttttttattatacaaccccgtttttttcatcgttgctggcctttcataaggggccaagattaccggatgattaataatgaatatactatttacggaatcatcaccgaatataggtggtcaggaattacaggctgttgctcaaatgaaggccctgaagaaaatggggcattcagttctgcttgtctgcagggaaaacagcaaaattgcttttgaagccagtaaattggggattgatatcacattcgcgttatttcgaaacagtcttcacatccctactgcatggagattactcggaatagttcatggttttcagcccaatgcaatcgtttgtcacagtgggcatgatagcaatattgttggtttagtacggttattcactaggaaacatccattcagaattatcaggcaaaagacatatttgacacgaaaaacaaaagttttttcaataaatcatttttgcgatgaggtgattgttcccggaacaagtatgaagacacatctggagcaggaaggatgtcgaacccgggttactgttgtgcctccaggctttgatttccagaaattatacgttgattcccgaaacagtttgcctccaaatgttctttcttggctggcgtcccgaaggggatgccccgttattgctcaggtaggaatgttgcgcccggaaaaagggcacgaatttatgttgaatttactgttccatttaaaaatgaatggacgacagttctgttggttgattgtggggtctggttcgcctgaactgcgggagcatttacagtatcagattgacagtatgggcatgcatgatgatgtttttattgctgacaatgtttttcctgccgcccccgtatatcgggttgccagtctggtggttctgccttcagaaaacgaatcgtttggtatggtactggcagaagcatcggcattttctgtgcctgtactggccagtcagattggtggaatccctgatgttattcagaataaccagaccgggacattgttaccagcaggtaataagcacgcatggatgtgcgccctgaatgatttttttaatgaccctgggcgtttttatcagatggctcgccaggcaaaacaggatatagaagagcggtttgatattaataaaactgcgttaaaaatactcacattagcgaagcacaagtaacaatatgttttctgtaagtaacttatcatttatcggtttccttaaaaggattgttttttcctcagattcactcccggggaagtgggaacacagaaaattccggttcatgtacattttgcgatgtgctataaatccggttgccagtattcgatattattacgaactgcgttccttgcagtgcattgaggatattctggcaatacaacccacgttgccagcaagaattcatcgaccttatttgcataaaggggggcgagcctggtcccgggggcaatatattcttgagcattatcgctttgtgcaaaatttgccagaaaaatattctgaatttttgtttccacaaaaatcggtatcattagtccaattcatcgggaaagatggagaggattttgatatccagtgttctcccagtggttttgaccgggaaggagagttgatgttgtcattgtttttcaataaaatagtgattgcccggttaacattttcagtcattctgactcaaaatggacacaccgcttttattggcggattacagggagcccccaaaaataccggacctgatattattcggtgcgcaacccgggcctgttatgggcttttcccaaaacggattatttttgaagcattttgtgcgttgatgaaagcttgtaatgtctctgagtgtctggcagtcagtgagcacagtcatgttttccggcaattgagatactggtatcagaaacgcaaaacctttgttgctgtctacagtgatttctgggagtctgtagcagggaaaacctgtggtgactggtacaaattaccaacacaggtggttcgaaagccgctaagcaatatagctagtaaaaaacgctctgagtatcgaaaacgatacgctttgctggattatatccatgaaactgctatccgctctttggatgcatatcctgtaaactcagaacattatgacttaaattaaggttagatgtattctctgaataaaatattaatgatgattatggtaggggcattcgcactaaataatgaaaaaatacaaatccgagtttattcctgaatttaagaaaaattatctttcccctgtttactggtttacatggttcgttttgggaatgattgcaggtatttcaatgtttcccccttcattcagagatcctgtcttggccaaaatagggcgttgggtgggcagattgagcagaaaagctcgtcgcagggcgacgattaatttatcgctttgtttcccggaaaagagtgatacagaacgggaaataattgtcgacaatatgtttgccacagcattgcaatccatagtgatgatggcagaactggcaattcgtggtccggaaaagttccagaaacgagtgttctggaaaggcctcgaaattcttgaggaaattcggcacaataacagaaatgtgatttttctggttccccatggctggagcgtggatattcctgcaatgttgctggcagctcagggggaaaaaatggccgccatgtttcatcagcaacgaaatccagtgattgattatgtctggaattctgtacggcgtaaattcggggggcgcttacattcccgggaggatgggataaaaccatttattcagtcagtacgccagggatactgggggtattaccttccagatcaggatcatggtcctgaatacagtgaatttgctgatttttttgcgacctataaagcgacattaccaattattggacgtctgatgaacatcagtcaggctatgattataccgcttttcccggtttatgatgaaaaaaaacatttcctgactattgaagttcggccaccaatggatgcatgcattgccagcgcggacaataaaatgattgcccgacaaatgaacaaaacagtggaaattttggtggggtcacatccggaacagtatatctgggttttaaaattgttaaaaacgcgcaaatcaaacgaagcggacccgtacccttgaaattataaagtacaggtatttccactagttgtttcttacaggttaccaatcgaaacacatcccccttccgtgtgttgcccgtttggcacggaggactgtgtagatgcagttcgttaaatttaatttatgcctaaatagctgcgcttaataccgctacacttttgccagcccatgtttgcctccggggaatgggctgacggtttccataaaatggcgaacttttttcaacagttgccacattgagcggcactgatgattacgcgttattgtgtcgtgaagtgcctgccatagccgttcaacatgattcacccatggcgagtaaaccggctgataaatgcccctgaacttcgggttctccttcagccagctctgtgtttcccggcttttgtggataatgtagttgtccacgatcagcgtgatggttttcgcacgacggtatgtcgctttaagccgcttcagcaggctgatgaacagcgccgaacttttgctgttgccgcccacatagctgactttacctgtcccgctgtgcagcgctccggccagataatatttttcattctgtcccggcgtgaccacccgtttttgctgtccgcgcagttgccagtccgcaccgattttgggatgaagatggatatccacttcatcttcataaaagaccggatgctctgcgctgcattcgtccagtgctttatggattgctgccatcttttcatctttatgcgggtcacggatacgcagagttggcgcagcccttcgccacacaatccccacagacggcaaccagcggcgaacggttccggcatttaactggcaaccggttatctcattgatttttattgccagcagttctgtactccagcgtgaacgctggtagccaaagtcgccgggagaatgttttaccagctcacgtaacagtgtgcagatatgctcaaacggccagcgacgggcacgcccggcaggtaatgatttcagtccctcaacacccgactgcgtgaaccagttaatccagcgtccaacagaggagcgggcgcagcagagcgttctggcaacgtcgctgacacggtcgccccggtgcagctgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccagactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaactatccctcctgtgtggcaacatacgtcaggtccgccacccagacctgatttggtgctgtaggagcgaacgtctggttcagcagatttggcgcaactggcagattgtggttcgggttcgtagtcgctctgaacttgcgtttctgcttacagcgtagccttagctccttacgaagacgtgccagtcggtcacgaccaacgatgatgccattctctgccagctccgtctggagccgccgggttccatatgtttcgcgagtgcggatatgtgccaccttaatctccagttttagccgctcatcactttgttttctgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgctttttttaatatatctcgctcaaggcgagcttcatttaacgccttacgcagttgcagaatttcagattccagttcagccagcgtgcgggaaccaggagtaccgagcccttttctggcggcggtaacccattgtcctaaagtgccttcaggaaggaataatcgggaagcgtcttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcagatcagtgaatccggtgaagtggtggatatggccgcttatgaggcatggcagcaggaaaatcatccggacacctggcagcagatgcagcgtcgtgaagaggtgaacatcaatgtgcaccgggaacgcggggaggatgttgagccgggagatgatttctgatgaacaggtcagctccagtcttcagttctcaggccgcccacacgttcaaattcccgggtgttattagtcacaataatcagcccccgactgcgggcatgacctgcgatcatttgatcaaatggcccgacagggcgtccctgacgggcaagttctgctcttatctggccggtgtgtgtggctgcagcagcgtcgtaatccagaacatcaatgcgggaaacaaatccctcgatcacagcgagattacgttcaggcatctggcttttttctgcaccatatatcagctccatcagggtgaccgaactgatacacattttcccctggttcaggttaaaacgctccctgacgctggcgggtttgttctttatcgtaaaaatgcagatgttggtatcgagcataaacttcagcatcagaatgactccctttcttgcatgccgggctgttccctgttatccataaaatcggtgctgacgctgtgtccgtcgaaccattcgtcccatgtctctccggctggcgtaatgattctggttcgtccgacagcaatcacttcaacgcgttttacgttttccggcaatgcaaccgcttttggcagtctgaccgcctggctgcggttgctgagaaatacggtggtttccattatttgcctccttatgtggatatgtcttgtgtatatctattgtgggattgataccgggatatgtcaaagggatatacgtttatgatgagtatcgcgcaggtcagatcggccggaagtgccggtaattattataccgacaaggataattactatgtgctgggcagcatgggagaacgctgggccggccagggggctgaacaactggggctgcagggcagtgtcgataaggatgtctttacccgccttctggagggcaggctgccggacggggcggatttaagccgcatgcaggatggcagtaacaggcatcgtcccggctacgacctgaccttctccgctcccaaaagtatctccatgatggccatgctcgggggggacaaacgtcttattgaagcacataaccaggccgtggattttgctgtccgtcaggtggaggccagtgcctccacctgacggacggacagtcagaaacggtgctgaccggtaatctggtgatggcactgtttaaccacgacaccagtcgcgatcaggaaccacagttacacacgcatgcggtggtgactaatgttacgcagtataacggcgaatggaagacactgagcagtgacaaagtggggaaaacggggttcattgagaatgtgtacgctaatcagattgcctttggcaggctctaccgggaaaaactgaaagagcaggttgaggcgctgggctatgaaactgaagtggtcggtaagcacggtatgtgggaaatgccgggtgtaccggtggaggccttttccggacgctcacagactatccgggaggccgtcggggaagacgcctcgctgaaatcccgggatgtggcggcgctggatacgcgtaaatccaaacagcacgtcgatcctgaagtcagaatggccgagtggatgcagacgctgaaggaaaccgggttcgacatccgggcatatcgtgacgcagcggaacaacgggcatatacccgcacgcagacacccggacccgcttcacaggacgggccggatgtgcagcaggcggtgacacaggccattgccggattaagtgaacgcaaagtgcagtttatgtatacggacctgctggccaggacggtcggcatactgccgccggaaaatggtgtgattgaacgggcacgcgccggtatcgatgaggccatcagccgtgagcagcttatccccctcgatcgtgagaaggggctgttcacgttcgggattcatatgctcgatgagctgtcagtccgggcactcagtcgtgacatcatgaaacagaaccgggtgaccgtacatctggagaaaagtgtcccccggacggccggttacagcgatgccgtcagtgttctggcacaggaccgtccgtcgctggccattgtgtccgggcagggcggtgcagccgggcagcgtgagcgggtggctgaactggtcatgatggcccgggagcaggggcgggaggtgcagattatcgctgctgaccgtcgctcgcagatgaacctgaagcaggatgaacggctgtccggtgaactgataaccggacgtcgtcagttgctggaaggaatggccttcacgccgggcagtaccgttatcgtcgaccagggcgaaaaactctccctgaaagagacgttaaccctgctggatggtgccgcacgtcataacgtacaggtcctgataaccgacagcgggcagcgaaccggtacaggcagtgcactgatggccatgaaggatgccggggtgaacacatatcgctggcaggggggagaacagcgaccggccaccatcatcagtgaaccggaccgtaatgtcggctggccggagattttgcggccagcgtgaaagccggagaagagagcgtggcacaggtcagcggagtacgggaacaggccatactgacacaggccattcgcagtgagctgaaaacacagggcgtgctcggacacccggaggtaaccatgaccgccctgtcaccggtctggctggacagccggagccgttatctgcgggatatgtaccgcccgggaatggtgatggagcagtggaacccggagacacgcagtcatgaccgctatgtgacagaacgtgtgacggcgcagagtcacagcctgaccctgcggaatgcgcagggcgaaacgcaggtggtgcgtatttcttccctggacagcagctggtcgctgttccggccggaaaaaatgccggtggcagacggtgagcgtctgagggtgacagggaaaattcccggactccgcgtctccggcggtgaccgcctgcaggtggcatccgtcagtgaagatgcgatgacggttgttgtgccgggacgggctgaaccggccaccctgcctgtgagcgattcaccgttcacggcactgaagctggagaacggctgggtggaaacgcccgggcattccgtcagcgacagtgcgacggtttttgcctccgtcacacagatggcaatggacaatgccaccctgaatggtctggcccgcagtggtcgtgatgtccggctgtattcctcactggatgaaacccgtactgcggaaaaacttgcccgccatccctcctttacggtggtttctgagcagataaaggcgcgtgccggtgagacattgctggaaaccgctatcagtctgcagaaagccgggcttcacacgccggcacagcaggccattcatctggcccttcctgtgctggaaagtaaaaacctggccttcagcatggtggacctgctgacagaggcgaagtcgtttgctgcagaaggaaccggttttgctgacctgggaggggaaatcaatgcgcagataaaacggggtgatttactgtatgtggatgtggcaaaaggctatggcacaggcctgctggtttcccgtgcgtcgtatgaggcagaaaagagcattcttcgccatattctcgaaggtaaggaggcggtcacgccgctgatggagagagtacctggcgaactcatggagaaactgacatcaggacagcgcgccgccacccgtatgatactggaaacgtctgaccgtttcacggtggtgcagggctatgccggtgtgggtaagaccacacagttccgggcggtgatgtcagccgtgaacatgctgccggagagtgaacgtccccgtgtcgtggggctggggcccacacaccgtgcggtcggggagatgcgcagcgccggcgtggatgcacagacactggcgtcctttctgcatgacacgcagctgcagcagcgcagcggagaaactccggatttcagcaacacgctgttccttctcgatgagagctctatggtgggcaataccgacatggcacgggcatacgccctgattgcggccggtggcggtcgggctgtggccagcggtgacacggaccagctgcaggccatcgcgcccggtcagcctttccgtctccagcagacgcgcagtgctgccgatgtggtcatcatgaaggagattgtgcgtcagacgccggaactgcgggaggcggtatacagcctgattaaccgggatgtggaaagggcgctgtccgggcttgagcgtgtgaaaccgtctcaggtgccacgtctggagggcgcatgggcaccggagcactccgtgacggagttcagtcacagccaggaagcgaaactggcagaagcgcagcagaaggcgatgctgaaaggcgaggcttttccggatgtccccatgacactgtatgaagccattgtccgcgactataccggcaggacaccggaagcacgggagcagacgctgattgtcacgcacctgaatgaggaccggcgcgtactgaacagcatgattcatgatgcacgggaaaaggccggagaactggggaaggtgcaggtcatggtgcctgtcctgaacacagcgaatatacgcgacggggagctgcgtcgtctctccacctgggagaataacccggatgcccttgccctggtggataatgtgtatcaccggattgccggtatcagtaaggatgacgggctgataaccctgcaggatgcggaaggtaacacgcggctgatttcgccccgggaggcggtggctgaaggcgtcacgctgtacaccccggacaccatccgggtggggaccggtgacaggatacgcttcacgaagagtgaccgggagcgcggttatgtggccaacagcgtctggacggtgacagcggtttccggtgacagtgtcacactttctgacggtcagcagacccgtgtgattcgccccggtcaggagcgggcagagcaacatattgacctggcctatgccatcaccgcccacggtgcacagggggcgagtgaaacctttgccatcgcgcttgaaggcacggaaggtaaccggaaactgatggccggctttgagtcagcctacgtggccctgtcgcgtatgaagcagcatgtgcaggtgtacaccgataaccgtcagggctggacggatgccatcaacaatgccgtacagaaaggaactgcccacgatgtgtttgagccgaaaccggaccgggaggtcatgaatgcagagcggctgttcagtacggcgcgggagctgcgggacgtggcggcaggccgtgccgttctccgtcaggcggggctggccgggggagacagtcctgcacggtttattgctccgggacgtaaatatccgcaaccgtatgtggcactgccggcgtttgaccgtaacggcaagtccgccggtatctggctgaacccgctgaccacggatgacggaaacgggctgcggggattcagcggtgaaggtcgggtaaaaggcagcggggatgcgcagttcgtggccctgcagggcagccgtaacggagaaagcctgctggctgataatatgcaggatggcgtccggattgcccgtgataatcctgacagtggtgtggtggtaagaatcgccggtgaaggccgtccgtggaatcccggtgccatcaccggtggccgcgtgtggggggatatcccggacaacagcgtccagccaggagccggaaatggtgaaccggtcacggcagaggtactggcacagcggcaggctgaagaggccatccgccgtgaaacggaacgtcgcgcagatgaaattgtccgtaaaatggcagagaacaaacctgacctgccggacggcaaaacagagcaggctgtcagggaaattgccgggcaggagcgtgaccgggctgccataactgaacgggaagccgcgctgccggagagtgtactgcgtgaaccacaacgggtgcgggaagcggtccgggaagttgcccgggaaaatttgctgcaggagcgtctgcagcagatggagcgggatatggttcgtgacctgcagaaagagaaaaccccgggcggagactgatacaggaagacaaacactgatgacaacggataacacgaacacgacacgtaacgattcactggctgcacggaccgatacctggttgcagtcatttctggtctggtcacccggacagcgggatatcatcaaaacggtggcactggtgctgatggtactggaccacatcaatctgatattccagctgaagcaggaatggatgtttctggccgggcgaggagcctttccgctttttgccctggtgtgggggctgaatctgtcccgtcatgcgcatatccggcaaccggccattaaccggctgtggggatggggaattattgcccagttcgcatattatctggcaggctttccttggtatgaggggaatatcctgtttgcctttgcagtggcggcacaggtgctgacgtggtgtaccacgcgcagtgggtggcgtacagcagcggccatactcctgatggccctgtgggggcctttgtccggcaccagttacggtattgccgggttgctgatgctggcagtcagcaaccggctgtaccgggcggaagacagagcggaacgtctggcgctggtcgcctgcctgctggctgttattccggcgcttaaccttgccaccagtgatgcagcggcggtggccggtcttgtgatgacggtgctgaccgttggtctggtgttgtgtgccggaaaatcattaccccgtttctggcccggagactttttcccgacgttctatgcctgtcatctggctgtgctgggcgttctggcgctgtgacgggtgtggtatctttggccgcaagaggatgattcgtcagaggcagaacacagcatgacagagcagaagcgaccggtactgacactgaagcggaagacagagggaacagcgcctgtccgcagccggaaaaccatcatcaatgtcaccacgccaccaaagtggaaggtgaaaaagcagaagctggccgagaaagcggcccgtgaagcagagctggcggcaaaaaaagcgcaggccagacaggcgctgtccatttatctgaacctgcccacgctggatgaggctgtgaataccctgaagccctggtggccgggattatttgacggtgacacgccccggcttctggcctgcggtatccgggacgtgttactggaagacgtggcgcagcggaatatcccgctctcgcataaaaaactgcgcagggcgctgaaggccatcacccgttcagaaagctatctgtgtgccatgaaagccggtgcctgccggtatgacacggaagggtatgtgacggagcatatttctcaggaggaggaagcgtatgcgggagcgcgtctggcgaaaattcgtcgccagaaccggataaaggcagaacttcaggccgtgcttgatgagaaataaaaaaagcctcccccagagagaggaggcagggaaataaggcttaaaaggaaataacttccgcttccgaaaggaagccagtccactgaattatttatcacaataatactgacaactaaagggggacaagaaaatgaatggattcagaaacagttcacggaacggccaggtctggcgttaccagcgtgccggcgggcgggccgttattctggaagtcagtggacgctggatggaagcggcagaagcatggcgacgggctgcctgtgttgcgcctaggacagactggcagcagtttgcccggaaaagggctgaacactgccaccggcgctgccggggaagggtgtaacgaaaaaagcagccttcattactctaggagtcagaaggctgaaaggagtttatgagatttgcttcttaatatccggtcgggcagtatgaccggacagttctgagtagcacagagtcttttccgcattaagtcgattttttatattttgtgattagtttcacaaaataaggtgttattcaatgtgtgctgcactattcaggggggctgaaatacaggtggcatttatctgatatggagaataacatgaggaaatatattccactggcattatttatcttttcatggccggtattgtctgcagatattcatggacgggttgttcgtgtactggacggtgataccatcgaggtcatggactcactgaaggcggtgcggatcaggctggtaaatattgatgcaccggaaaagaaacaggattatggccggtggtcaacagacatgatgaaatcactggtcgcaggaaaaacggttaccgtcacatattgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccagactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgtaggagcgaacgtctggttcagcagatttggcgcaactggcagattgtggttcgggttcgtagtcgctctgaacttgcgtttctgcttacagcgtagcctcagctccttacgaagacatgccagtcggtcacgaccaacgatgatgccattctctgccagctccgtctggagccgccgggttccatatgtttcgcgagtgcggatatgtgccaccttaatctccagttttagccgctcatcactttgttttctgtctgagggttcatgctgtacccagttgtaataaccgctcctggatacaccaaatacctgacacatcgcttcaatgggaaattgttgtcgccattgttcgattaacgcgtatttttcagcgactcctgtgcaaaatacgctgttgctttttttaatatatcgcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactctttagagtaacgttgggtttttctgctcattattagctccttctgatgccattctatttcaggaaggagtgtccgttaaactcaggctacctcatattttcagcgagatcgttatggtcgtattctcgggcaggtttatgcaccagacggaatgaatattaatcagtttatggtccgggccggggctgcctgggtatatgagcagtacaacacagatcccgtgctacctgtccttcagaacgaagccagacaacaaaaacgtgggctctggtcagatgctgatccggttcccccctggatatggaggcaccgtaaataaagcgatggcaatcctatcattcatctgttctcagcgggaataaaaatggcaaaaacaaaacaggaatggctgtatcagttacggcgatgttcatcagtcaatacgctggaaaaaattattcataaaaacagagacagtttatcaaacagtgaacgtgaatcatttaattcagcagcagaccaccggctagcggaattaatcaccggaaagttatatgacaggataccaaaagagatatggaaatatgtaaggtaataattcagcaataattaattgccaggagcagataaataatgaagttgattatttttattctcattgttctgattattgcagcgctacttatccggattatcctcagaagtgtaaatcagcattctcctttgctgatgcaattgcatgcggcaggtatacggactggtgatgcagagcgaatactgtccagcggtgaatactggcaacgtcagaagacgctgctgacagaaagggaagtcagttttatgaaaggactgttcagaattgtggatatgaagcggtggtatctgtgtccgcaggtacgggtagcggatatcgtccagctgaacgggaatatccggccacgatcacgccagtggtggcagttattcaggatggtgtctcagtggcatgttgatgtggttatcgttgagctgcgttcgttcagtattgttgcagcagtagagctggatgatgccagccatttacgaccggaacgcagacgccgggatattcttctggaagaggttctgaggcaggctggtattccgttgctcagaagccacgatgccagaaaactgctgcagatgaccggagaatggctgaatacaacaggggctgatcagcagtcaccggaacatcgtagctgacgccttcgcgttgctcagttgtccaaccccggaaacgggaaaaagcaagttttcctcgctcccggcgtttccataactgaaaaccatactatttcacagtttaaatcacattaaacgacagtaatccccgttgatttgtgcgccaacacagatcttcgccacaattctcaagtcgctgatttcaaaaaactgtagtatcctctgcgaaacgatccctgtttgagtattgaggaggcgagatgtcgcagacagaaaatgcagtgacttcctcattgagtcaaaagcggtttgtgcgcagaggtaagcctatgactgactctgagaaacaaatggccgctgttgcaagaaaacgtcttacacacaaagagataaaagtttttgtcaaaaatcctctgaaagatctcatggttgagtactgcgagagagaggggataacacaggctcagttcgttgagaaaatcatcaaagatgaactgcagagactggatatactaaagtaaagactttactttgtggcgtagcatgctagattactgatcgtttaaggaattttatggctggccacgccataaggtggcagggaactggttctgatgtggatgtacaggagccagaaaagcaaaaaccccgataatcttctttaactttggcgagtcagaaagattaccggggcccacttaaaccgtatagccaacaatcaagctatgcggggagtatagttatatgcccggaaaagttcaagacttctttctgtgctcgctccttctgcgcattgtaagtgcaggatggtgtgactgatcttcaacaaacttattaccgccaggtaaagaacccgaatccggtgttcacaccccgtgaaggtgcccggacgcttccgttctgcgggaaactgatggaaaaggcggtgggcttcacctcccgttttgatttcgccattcatgtggcacatgcccgttcgcttggtctgcgtcggcgcatgccaccggtactacgtcgccgggccattgatgcgctgctgcaggggctgtgttttcactatgacccactggccaaccgcgtccagtgttccatcaccacgctggccattgagtgcggactggcgacggagtctgctgccggaaaactctccatcacccgggccacccgggccctgacgttccttgcagagctgggactgattacctaccagacggaatatgacccgcttatcgggtgctacattccgaccgatatcacgttcacatctgcactgtttgctgccctcgatgtatcagaggaggcagtggccgccgcgcgccgcagtcgtgtggaatgggaaaacagacagcgcaaaaagcaggggctggataccctgggtatggatgaactgatggcgaaagcctggcgttttgttcgtgagcgtttccgcagttaccagacagagcttaagtcccgtggaatgaagcgtgcccgtgcgcgtcgtgatgcggacaggcagcgtcaggatattgtcaccctggtgaaacggcaactgacgcgtgaaatctcggaagggcgcttcactgccagtcgtgaggcggtaaaacgtgaagtggagcgtcgtgtgaaggagcgcatgattctgtcacgtaaccgtaattacagccggctggccacagcttccccctgaaagtgacctcctcagaataatccggcacgcgccggaggcattcgcacgcctgaagcccgccagtgcacaaaaaatcagcgctacatacaaaaaacaacctcatcatccaccttcaggtgcatccggtcccccctgtttttgatacaaaacacgcctcacagacggggaattttgcttatccacattaaactgcaagggacttcaccataaggttacaaccgttcacgtcataaagcgccagacgtcaaccctacagggtgcaatgtatcttttaaacacctgtttatatctcctttaaactacttaattacattcatttaaaaagaaaacctgttcactgcctgtcctgtggacagacaaatatgcacctcccaccgcaagcggcgggcccccaaccgaagccggtttagttacaacatgcaaacataaacccctaaaaaacccaagtccaacgcaaaactgaaaccacaacgcccccctcataactgaaaagcgccgccgcccccgcccaaagggcgggaacagagtcgcttttaattatgaatgttgtaactacatcatcatcgctgtcagtcttctggctggacgtatcgaatacacgctcgtaagcggccctcacggcccgctaacgcggagatacgccccgacttcgggtaaaaccctcgtcgggaccactccgaccgcgcacagaagctctatcatggctgaaaacgggtatggcttggcagggctggggatgggtaaggtgaaatctgtcaatcagtaccggctgacgccgggcttcggcggttttactccggtatcacatgtaaccacagcgtgccgccttccatgccgctggcgcggcatcagaataatacaagcagcatttaatgcatttgcaaaagtgtgagtaatattaagtggtcgtttcagggatatcgttaagacttgagcgataggaattaaaaccccaaaaagattaaaaaaacaccacaaaacggatgtttcttcaacaccacttttgctccatatgaacggaaccgacgattaaactggatggctctgattgattcagggtatgaatggcggttttttgctccgtttccctcaaaatggacgcaacttcccctctgcggctctcagccgcaccaccgcatccgggccagcggctcatgcatcaggacctgctctgccagacggtagccccgcttcagccccgtaaaacgcatctgactcccgcacagcacgcattcgaacgggtcacgactcaggaactgtttcaccatttgtgcatagcacactttcgccactggttccggtttatccatccccagagcacggtacacctgcggcagcttctctccacacacccggttggcaaggaacccgaagtacctcaccatcttaaaaaacttctccgggatgtgctgtttcagcctcgcgaccagctcacgctgtgtcagcgtttccgtcgccgtttctcccgttttgtggtccaggtaacggaagctcaggctcgcccctccgttgtaatgtgccagccgggaggccgctatcggcggcttcttcagataacgacccaggtagcgcgccgtattcctcccgccggccgtttttttcgacatgtacacatgccagtattttcctccggctttcagcaccaggcttctcctctgtgattccgtcgtgatatgtgacaacgactccggcatcgccagcccctctgaccacgctttcagaagccgttgccgcatattccacatccaccgcgaacgcatcgcgtctttcaggaagctcagctttttccactgaccatgcttattcagacctccacaggttacagacacatgtacatgcggatgccagttgagacgacggccatacgtgtggatggcgcagaagataccgggttcctgcccccgtttccgggcggcatacagcagattctccaccgccagacggcacacgtcattcagcagccaccggttgctttcgaacaccggccactgcgtgtccggcagggtgaagaccaggtgtacccagtcgcagtcaggaagacgattcagctgtgtcgctatccacaggtctgtggccttttttccgcaggacgggcaggcacggctgccgcatgagttagtgacgtatctgacgtgggggcactcaggtttatcgcagatgtattccttcacgcccagtatccgcgtgccgcaggccagcatttttgtgacagcctcaacctcgatatcgcgcagaccgcccgcatccaggaaggatgtccagcactggttggttgtgaacaggcgtttcagcggtcggggagtaaaagcggacaacatgaggacggattaacccccggtatcctgtagccgggtaagggctgctgtgtcgccacggcgctccaggatggaggccgcgaccatcgcaggtggtgggtccatgggtttgagcatcttcatccagtcccattcacgttgtgagagcttctcagcaccaacagagagcagaacggtatctatacttttgcgggtcaacataagaggatgagtccttaataaaacaggtcctcagagcatacatattctgcggagcgtgcggcaacaccaggacgaacaggggcagttttcaatttgcagccgtcaggctgccgtggttcactccaacaacggagacaggtaaattatggacgaaaagaagcttaaagcccttgcggctgaactggctaaaggcctcaaaaccgaggccgacctcaatcagttttcccgtatgcagacgaaattaactgtcgaaacggtgcttaatgcggaactaactgaccatctcgggcatgaaaaaagctacatccggtagtaaacattatcagtgggttatgcgatatgatttgagccgttttcagacaatcgcagggccagtacctcgtcagtcaactgacggtaaatctgctgttcagtctcacgcatcacctgtgcaccggcttccctctccgcatccgcatcaccgctcagacctgatgctttcagccggtcagccaccctctgagagtactcattctccagcatctcatacttctgctcttctgcctgcgcccagcggtcagcttccgtacgcttcagtacagcatgccatggtccccagagggagaaccagtccgtaaattcattctcttcacggcttctgaccatggcttcggcagtgcggaggtcatttgctgtcactcccgacacgccatagaaacgcatttccttcacggcagtagagagctgaagtttctctgcgagcatggtctggaaggccaggtagacttctatctcatccacaaaatggagagttctgactttatcccgggcaatgtcctccagaatttcgaggcggaacatttccctgcccagggagagcagagcgccggtatcattatcgaaaaggccttctgatgcctgatggaccaggagggttttccggagattgttccatgtgagcgcgacacggtcctcacagctctcagtggcatcagcagcaacagcgaaagactgctgtcgaagctccgcagaggcactgagtttttccagccatgcagcgacctgttcacggaatccggaggtattgcgtgcagagacggtatcggaaaggcggtcaaggaacgcggaaaaggtgttggcatgctcttcatgttcaaaagcatgccatatctgtgatacatcagattgtttgttttccgggaaccatgctgtcacggcatcagccagggagtgttctggagcggaaattgtggcagaatttcccatagagaaaaatatttgaggaccagaataatctggtccggtggttatttgttgtagtgtacgcatggtatggccagacaatggattacctgcaacatttacgaaggcattctgagctaatctcaggacactttccggaagtgttgtcagattattattcattagcacagccctgttcatactaaaaggtaattccggtagttgttctataaaattattagccagagccagcccttcaagcttatctggaaaggggggaatgctgtctaatctgtttccagaaactaccagtaattttagttccggtggcaatagtggcagaatatgcaatcggttattatgaacccgtaaatgagttagattttcaggaagaaatggtaattcttttatcttgttatcacccgcattaagctcttctaacgtctcgggtaaggcaggtaagctttccagttgattaaattgagcatgtattaccttaagcattggtggtaaatcagggagatgtgttaataggttttttcttatttccagtgttgttatctgaggcggtaaatctggtaatgtttttaaatctaactcagataaatttaattctgcctcttgattttgtaaacatattttcagcctattgaaggcgatattgcgttgctcgcctggggtaccgttcttttcccattcgctccaggtttttaaataaaattcattacaagatggagtcagttccataggtaaagataatggagttaacgagtatacattgtttatttgatgcataatgccagaaccgattgcctgtatattggttgatttaatcattataactagaattcttatcaacgataagaattctagttaaatagaatatggcttattaattttaaaacagtttgctttgtaccctttctccgggtattgctttccccctaagccgtctatgggaaggagtctgctgttattcctgagaatggtaattcagccataaaaaggtatttaaggtcattgcgtctctccctatactcgaataatggtgaagaaagcatgatgaatatatcacgataacgttcagtacgtatcgaggatagatggagttactcctctctgaaatagaattactgctctatttttttctgttttcagaagttattagtaacaaaccctgatatatttttttgaaaatggagcttaaacgagtctgaaattaacttcagaaatcagaataccgttggctttgtttttcatcaattccggcttcatttatctttgtcaaccattgcatttctgtagcagtgaatttcaacgttttcgtccggctggcagcaggtatttgtaattcgtatatagctgcttttttattgaaaacagtatatccatctgtagtaacagtagaagataataatacaggatttgatacttcaaggatgatattttcttgtttttgtggaagacaagggaatatagtttgtgtaagcatattacttccttatgttatattttggtaaaaaatttatttttttacattatagtcggctaaatgaagtttactgtaaaaaaacgatactttttcgggtggcgcttccaatcagtagaatatgtgtttttcaatgaaggagccgatgacttttcgtggatttccacggaacgcgagaagcagattgttttacgtgccagccgcttgatgcgggtgcggagggtcaggttgttacgttcaagatatagcatgtgctggatgaagatcccttttctggtcacctgtttatctttcgtggccgacggggtgacactgttaaaatgtaatgaacgcatcccacacaattaaacacggagtagtatgatggttaaaagggtgaaactggcaggtgtggagcctcgcagctttccggcatcatactgcccaatacgggatgcataaagcgtcctcagactggagactccacaaatgaaatatacaccggttggcgttgatatggcaaaacatgtcattcagattcacttcatcaatgagcacatgtcagcgccagtgatataagacggtaatggggatgcggacgatttcctggactctcagaagatgaaacatgtttactgaagaacaaaaaattcgcgctattgagctttatttcaaatatggtaagaagcttgaggtgtactggcaatagcggacaccaccatttgttctttttctaagcagtcatctgataatattttatcctgaaggctgccggggagatattccccagacgagagttgaggtagcctgagtttaacggacactccttcctgaaatagaatggcatcagaaggagccaataatgagcagaaaaacccaacgttactctacggagtttaaagccgaagccgtcaaaacggttcctgaaaatcagctttcgatcagtgaaggcgcttcccgattatctgttcctgaaggcactttaggacaatgggttaccgccgcaagaaaagggctcaatacaccaggctcccgcacagtggctgagctggaatctgaagttatgcaactgcgtaaggctttaaatgaagcacgacttgagcgagatatattaaaaaaagcaacagcgtattttgcacgcaatccgcgcccgatccagcagtgttttaagttcacgctgctcgcgttcagtcatctctttttgggtaatacgggggagtgccatgatggtgccctcagtgagtgaagtggcacactgaatttggccacctgaacagaggtgatatgctcacctcagaacaacacaggtgctccaatgaaaaaaagaaattttagcgcagagtttaaacgcgaatccgctcaactggttgttgaccagaaatacacggtggcagatgccgccaaagctatggatgttggcctttccacaatgacaagatgggtcaaacaactgcgtgatgagcgtcagggcaaaacaccaaaagcctcccccattaccccggaacaaattgaaatccgtgagctcaggaaaaagctacaacgcattgaaatggagaatgaaatattaaaaaaggctaccgcgctcttgatgtcagactccctgaacagttctcgataatcgggaaactcagagcgcattatcctgtggtcacactctgccatgtgttcggggttcatcgcagcagctacagatactggaaaaaccgtcctgaaaaaccagacggcagacgggctgtattacgcagtcaggtacttgagctacatggcatcagccacggttcggccggagcaagaagcatcgccacaatggcaacccggagaggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggctcaccatgaaagcgctggaaatggcatgggaaacccgtggtaagcccggcggggtgatgttccacagcgatcagggcagtcattatacgagcaggcagttccggcagttattgtggcgataccagatcagacagagtatgagccggcgcggaaactgctgggataacagcccaatggaacgcttcttcaggagtctgaagaacgaatggatgccggtggtgggttacgtaagcttcagcgaggcagctcacgccataacggactatatcgttggatattacagcgcactaagaccgcacgaatataacggtgggttacccccaaacgaatcggaaaatcgatactggaaaaactctaactcggtggccagtttttgttgaccacttcatacaattaatatacattaagtaacaggcattcgagccttgatttgagaaagcctgtcattcatttgttttatgtagctatctatttcctctgatgcataactaaaaagttctcccatttcacgagcaataataatctcagatttaatagactttaatctctggcgactcatctcttaacacttgcataatctctctttttatatcatatagttctataaaccgatttgcccgtagttctccttgggaagaatcatttctgaatacaacaattatatacaaaaaatcactattttctttagagaagatcttacaactaatctctgggagctcacataatgcatgtaagtcaggatggtacaaactatccacagaaaattgccccataggacgttttccagatataactgtcaaccagcttccttccggtgtactggcttcggctctggaaataggctgaaaatcttccggacatggagaatacattgtcttcatataattaagtcgtctggatttctcattaataaactcctctatttttaattgtgccatacttctggttataccagagatatacttcttgtcatatatgtttggtgattcattaaagtaaccatgttcaactctaggataaatatttctcactatatattcagtatttgcagtatttattggaaatacgttcttaatattcttgatgggactaatcattttaatctctatactcaaatataaacattaccatgaacaatataattgttcctaagtggaatgtctccacggagaacactttatctatcgggaaatagtgcgggcaacagtgtttaattatatcgagtgcaattacaatcgctggcgacggcaccgttggtgtggcggcctcagtccggaacaatttgaaaaccagaacctcgcttaggcctgtgtccatattacgtgggtaggctcacagagcctcacttacgactgcgtccatattatgtgggtaggatcaataaagacgttttatatgtgtctgcttgcagccagaaaatttataccctgcaggtatcataaacatgcttgataacttaattggggctccctcttccttttatggtgtaattgtttgattgaatacttccggggatttcagtatgaaatgaagtatatttaatatactttacaaaaagtttgtattagtggaataaggacaatagcttatccaaactgccaagcctctttattataagtaagatctggcactggaatattctcaaaaggactaacatcatcaccacgaccttcaaccaaccattttattgcatttaaatcccagaatagttcagtagtggtcaatttgggaaacgcacaatattgtacggttacgttatcgcaatagagtgaactctcgccctatacggcgttttcaaggattagtccttaatcggacaaccacattaaagcataataaataattaagctttaataatatactatagatacagttctattataaaaaatactattttaggtgatgcattaaattagtagaatatttattcttttataaaagcaccaatgaattgtccaagtaaacatgagataaaatgtgtagaggataactgagtttggtcactttaactgtattagtcgcagtctgactctcgactttaaaaggatgggaattacctgtactgatagtgagaaagctttccattgaaataagtcaaataaaagttgatggcttcagtgctaaagtgaggtgcccgctagccgtattcactcgaatcggaattcaatgtattgcttctgccatttccataatatttcacgggaaaaacaaaatctgaaaaactatacttaagtgttgtattgagtcagttgagatacaaatacatatttatcagcacacgttacgtcaaatacaggaggttgtcatgttggtactgaaaggcacgttggctattgcagccgtgatgacaatttattgtcttatcgttgttcttatggaacgcttttctgattgatttcatattggcgagagaacaagaaggtgagtagaattgtcgcggaatcctgaaactatcagcctcaggtatgaacaccaaaaggtaggtagagaaatctatggcccccgttactttattcgcacaatgaggtatttttttatttttacaaaagttcaataaatattataataaaagatatgttcttggtaacataaacaaatatttaattaaaataatgcttggcattgacgtttatcttataaagtaagaagatcatggacatttcaaccaaaaaagtagagttctcgatgaaattaaaattctttgtacttgcactttgtgtacctgcgatctttactacacatgctaccactaactatccacttttcataccggacaacatcagtacggatattagtctaggatctctgagtggcaaaacaaaagaacgcgtttatcatcccaaggaaggggggagaaaaattagtcaactggactggaaatacagtaatgcgactattgttagaggtggcatcgattggaagctaattccaaaagtgtctttcggagtttccggttggactactttaggtaaccagaaagcaagcatggttgataaagactggaacaattccaatacccctcaggtatggaccgaccagagctggcatcccaatacgcatctccgtgatgctaacgaattcgagctgaatcttaaaggttggttattaaataatttggattatcgacttggactaatagcaggttaccaagagagtcgttacagttttaatgcaatgggagggagttatatttatagtgaaaacggggggagcaggaataaaaaaggggcacatcctagtggtgaaagaacaataggttacaaacagctcttcaaaataccttatattggattaactgctaattaccgccatgagaattttgagtttggagcagaactgaaatatagtggttgggttctttcatctgatacagataaacactatcagactgagacaatttttaaagatgaaataaaaaaccaaaattactgctctgttgctgcgaatattggatactatgtcacccccagtgcaaaattttatatagaaggctccagaaattacatttctaataaaaaaggtgatacatctctttatgagcaaagtaccaatatatctggcaccattaaaaatagtgcaagtattgaatatattggttttctcacttccgcaggtataaagtatattttttgaattggttcaccgagttgattacgttttcatggctaaaaattgccgcccattgtgagtcatattcgccctgactttccagaaccatacgaactgcccgttgacggacttcgggggaaaaacgtgtatttttagtcattctgtttacctctttctcagggcgtttagtctccaggatttccggggcggttcaaaaaactcttcgttgattactgtggacttactgttggcattaccgaccctgagaccggagaaataagaaccgcttagatcatcgtggctgttctcggggtatcaagttacacatgggcagaggctacccaaggtctactattatcgcctgaaagcgctgatggaacagtgctatcagggac

SEQ ID NO: 203 - DNA, 136694 bp, Shigella flexneri
  OspG
atgctgatgaaaatacctaaataatcagccagcactctatctttccaaatccacagcatagcaaagagagcaaaagagcctgtaaattcagaaattaaggaaacgcctcttggtgtacataatctatcttatgttaaatgaaatctaatttcttgattatatgctggatcgttcgtgggtggctttgcccctatatttccagacacctgttatcattggcccgctgccgcagatattcccgtggcgagcgataatccagcgcactatgcggatgccattcgttataatgctcgaatgcctctgcaaggttctttgctgccgttaacccgtcaggtttgggcatgatactgatgtagtcacactttattgttttcacgaagctctttgctattctgttactctccggactccgcaccgccgtgttcttcggttcaacaaagtcccaacatccgggtgaactggcgtgtttcattagctcggtagcatgaaccattatccgtcagtcacttcactggagacgccggaagctcgttgccgaagcggtgttccaccgctcccagcatgtcgccaacgggagagcatctacggtctgattgaactgtttattcaaattgtccaccgtctgtcagtacgctctgaacgtcggctggttaaaacactgctcgctgattttcagaggggtcacggtaaaacagcacttttattccggattgcggaagcggctctgaataatccggatgggctggttaaagaggttgtgtaccatctgcatattgttgaaccagatcgcagcggtaagagaagttcatcatacttggcgcagttacgcgatgtttctgctagaggtgatgccgtaaagaacggcagaacattaccggaacaagatagcggtctacctgcactggtatcagacccggggcttccccggatgatctccacggtactttaggtactgtgtctatattatgtaggtaggatcaattaactttgtagttgaaattctttcattgaaataatgaataaaaaagacaaaccgcattaaacaatgccagaatataattgcatttttgttccgtttttttaaatcatagtatacaaagaagcttgcatactatatgaaaatataacaccctttactatgatgtttataaaacaatatatggagtcatgtaggtatgaatttagatggtgttagaccatactgtagaatagtcaataaaaagaatgaaagcatatcagatattgcatttgcacatataataaaaagggtaaaaaattcatcatgtactcacccaaaagcagcattggtttttttaggagagaaaggtttttgtgatagcaatgatgttctatctattatgggacaacaaataccaagagtatttaagaacaagatgttatatgattatgtttttaaaaatgaaaaaagtaaaaatgattttctaaaaatggctgaatcatggctaccacagagtgaaccaatagtaataaataatgatgatgacgcattgaatgctgctgcttatttttctgtaaaaaaagcgaaaataaaaacagtaaacgatactgattttaaagagtataataaggtttatattcttgggcacggtagtcctggttctcatcaattaggccttggttcggaacttattgatgtacaaacaatcatttcaagaatgaaagactgtggtattctaaatgtgaaagatatccgttttacttcatgcggctccgctgataaagtggctcctaaaaattttaacaatgcccctgctgaaagtctttcttgtatccttaactctctgcctttttttaaggaaaaagaatctttgctagagcagataaaaaaacaccttgaaaacgatgagtcattgagtgatggtctaaaaatatccggctatcatggatatggagttcactatggtcaagagctttttccctactcacattatcgttcaacttcaattcctgctgatccggagcatacagtaaaaagaagctctcagaaaaagacttttattattaataaagaactggattagtataaaatttttaacctatagttaattgtttgcatttaagatgaagttattttatctttagtagaaaagtgcttccctatgagggaaaatcacaaatcatcataatacagagacaaaacgatacgaaaaaatagataaaaaacatcattcttttaccacattatttttcgtgaatatgaaaaataatgttattactttaatataagactattttttgtttttccatcactctgttcaaatttttccgcatgacttgtgttttttgtaacacagctcgttttttacagctgaccaaaatcatcaattaattatgctaaggaaataaattatgaaaaccaaaaactttcttcttttttgtattgctacaaatatgatttttatcccctcagcaaatgctctgaaggcagaaggttttctcactcaacaaacttcaccagacagtttgtcaatacttccgccgcctccggcagaggattcagtagtatttctggctgacaaagctcattatgaattcggccgctcgctccgggatgctaatcgtgtacgtctcgctagcgaagatgcatactacgagaattttggtcttgcattttcagatgcttatggcatggatatttcaagggaaaataccccaatcttatatcagttgttaacacaagtactacaggatagccatgattacgccgtgcgtaacgccaaagaatattataaaagagttcgtccattcgttatttataaagacgcaacctgtacacctgataaagatgagaaaatggctatcactggctcttatccctctggtcatgcatcctttggttgggcagtagcactgatacttgcggagattaatcctcaacgtaaagcggaaatacttcgacgtggatatgagtttggagaaagtcgggtcatctgcggtgcgcattggcaaagcgatgtagaggctgggcgtttaatgggagcatcggttgttgcagtacttcataatacacctgaatttaccaaaagccttagcgaagccaaaaaagagtttgaagaattaaatactcctaccaatgaactgaccccataaagctggacagcctgtatcaggctatggagggcccatagacaaatctaccctatatgagcataggaggagtctatgggcacaccacgttttacccctgaatttaagggattactggaaaggctgggacatatccctccggcagaagcagaaaaagcttattatgctgccatcggaaacgatgatctggcaacctgagttcacagataaaacattctctaggaaactcggggcggttccgttcaccacatgcaatgtggtgttgcaggggaacggtctgcccatcccctatgtcgatcaatataacagaaatgacaacttcagattcagggcacaacctaaatatattttaggtcacctctcaaatcgtttgcctgataccgctccattttttaataaaaaaatcaatcatttttgaatctttgcttttcattgcattgtcaagcatagtgtccccactatttgctttttgaaattttttgtttacatcaaccaatccattattgataaaatattctagtactttatagttggcaccatctttactaagtaagtattcaacatcatacagattacaatatatattgttgttcattttctccatctctgcgacatcttgttttgtaaaattaaatttagatagtaaataaagtgctatatcagcttttttatcgcctaaagaataagcaagggcctgatgagccatttttttatcagtcactttattgttaatctcttcataattagatgctttaatcgcatcctccaaagatatgtctctgagttttatttttttgaagttatctgtacttagcattcttggtatatgatactcaagctgaaacacaaagtttataattctatccagactaacaggatcaatgtttttgttataacaaaactctcggaatccttgatctttactctttcctataaaatcaataagatgcaacccaattccaagcctcatatctttagtgttaaatattggaacatcagttttcccctgattaccatgcacatacctgctaacttcatccacaacctctttaaagttatctaagaaaaatgattggtgctcatggtaaaaaacaggtggaatagcattatcaaagtgctcggttaatgtcatatatccatatggagagtcatgatcaatgatatacgcattggcgccaaaatatacagtatgatgtgttttatttagtgggagtttttcttgatgattggaaatttcaaccccaaaaaacaaaatcgtggttagagatttctttaatatcctcagagtatgtattcttatgtgtttgtatattttcagactgaattttatcaaaggatttaatattaagaatattatttgacagattagagttactttgatgtctgaagttaaaattagaattaataataatagaaagtaagtgacgttcgtctgaagaaagaggatgaactttttgtattatctcagagatatagtgtctggacaccttatcgagatgctcaagtgaccgaaatgatgaccgtgctccagatggcgcttcaatagaaagatttagtgatttgaaactggtcccttgagaaaacattttgctataactttgcgctgctatagacttccttaaaaagtttttcacagtattagcacagtgatctaaatgtttttcacttatgccagaagaagatgagtttgttacgcgtaatatattttttgtaatgcttttgttgctttattcggattcgtttttccatcaacaagatcaatattattctgaacattaatatgatttactgcttcaggtattttcataaaatattccccattatgtgcgtttttatctatggttatttagaatatattatctaacttaatagtttcttgtgtgtattataacgaaatgaacatattttaatatgttgtacaatttttactctgaaatcccctgaaattaatcacacctcctttactgaaaggaattattgcaacggtattatttgtttttgtatatatatcttgcgccttgttatgtagttaatcctcagaatatgatagataaaatagagacacagagcagagcgtgttctaacatcatgataacataaaataattagtaacaataaatgaaagaatcatgggagctcaacaaaaagagagctaaatagctgtgtggaatagtagatcactttggcggtataatggcagatggtctgcatactttccggtaacaacatgggccagaagccccgctccggcataactgcgtgcaatgggttttgaaggcaccggtgcctgcacgatatggtcgcaccggcgacaggccagtttagggcgttgtttttcgataaccttaaaggcgctgctgataagctccagctgctctgacacatcacatcccagtggactgagttcaccaccacaggccggacagcattcctcttccggccggatgacccggggggcacggggaagtgaggctggtaacggtttacgggctgaagactggcgcagggaagatggcagtaccgggtcatattgctcacccagtgtttccgccatttcctcctgaagtgcgctgattcgctcctgtgcttcctgtatccaccgttcggtttttgcgcgaagtttttctgagcttttaccgaactgcatacgctgcagtttcgcgaccagcgccttcagtcggttgatttcggaaggcctggacaactgaatctgcgacccagacctgattaggtgctgtgggcgtaaagttctgattcagcagattcggcgtaaccggcagattgtggtcagagtttgtggtcgccctgaacttgcgtttctgcttacagtgcagcctcagctccttacgaagacgtgccagtctgtcacgaccgacgataattccgttatctgccagctccgtctggagccgccgggttccatatgtttcgcgagtgcggatatgtgccaccttaatctccagttttagccgctcatcactttgttttctgtctgagggggcatgctgtacccggtcgtaataaccgctcctggatacaccaggtacccgacacatcgcttcaacagggaattgttgtcgccattgttcgactaacgcgtatttttcagcgactcctgtgcaaaatacgctgttgctttttttaatatatctcgctcaagtcgtgcttcatttaaagccttacgcagttgcataacttcagattccagctcagccactgtgcgggagcctggtgtattgagcccttttcttgcggcggtaacccattgtcctaaagtgccttcaggaagagataatcgggaagcgccttcactgatcgaaagctgattttcaggaaccgttttgacggcttcggctttaaactccgtagagtaacgttggttttttctgctcattattggctccttctgatgtcattctatttcaggaaggagtgtccgttaaactcaggctacctcagataagcttgatacaactggtctggtatatacagtttctttgagtgcggttacgtccacagaggtaacggtaaaagtaaccccttgtcgggaccactccgaccgcgcacagaggcattttcatcgctgacaggccgcattgcctcgcagggctggaggaggatcggtgatatccggacgaccgtaccggcttacgccgggcttcggcggttttactcctctgccatgtgcaacaacggagtgccgccttacatgccgctggcgcggcatatcctggtaacatttttgttgataccaccttccggccttatcctgaccagtgggctttcctggcatcgatgataccgatgaacgcgcatgatattgagccgacgatattacgggcaactggaaatactcaccctctggatgtgacctttatccatgaagaagatttggccacaccatggaaacctgaacaatcatcagtttacgcccatgtaaacccctacgggatatttgaactcgatatggaaacaaggttgccaatcgaggtggttgcctgaaagttggcagttacccggtcactacaccttgttggagtgaacatatcaaaaacaggtaattacacaatttaaattacagtctcataaaaaatgattaaatctatttattatttcaataaacgtttttttcatcttctttgaaaattgttctgctatagtatccggttccagattgttctcttttattattctacaatactctaatattgtttctttgtctctatttactacagatacaaatacaccaggaataccatctttattagttgcggacagcatttcgaccaatcgtcttgtggtaaaactatagttttttagaatattacaaaaggcacgtattgtttcggtatggccattataaaatgccataaaaagtcctgatgtaccgttgggattttttatccataataattcatctatatattcctggtgaggggggagtatttttagtatatctccatacgccataatggcctttgtgtgcccattttgaagtgccataaacaacccatgctttactttcaataattctttaatttgttcactactaagcattttcttattaagcagacttccgaacatacgaatactatctgcatgtccattctgcaatgcaaaaaataacccaggtaaatcatggctgtctttcgcagctaatagatataatctcttatcggaagttaacggggttttaaagactatttccccataggcttttattgtgtctacatgtccgttcataaaagacatgcataaacccggcacattgtttgcccctaccgcagcaagcaatgtaagtattgtttcttgactaagattgcacatatttaatatcttaccatatacttgaataatgtctgaatatccgttttgaagtgctatataaaatgcaggagtaccatcagagcttctcgtggccagaaggttcaccagtttagattgagaaatttcaccatttttgtatttttccatcagtataaataatacttctgtcagattctttgttatcgcatgatatataactctggaattgatcaattcatctggtaaaagtttcactgtgtttgttagaggggaattatgcctatcttcaaatattacctgcccgggttgctccagaccataaattttccaataaaaatcatcaaaaaaatccttagcggataattgactcagttcgaaatggctatcacaagtaaatacagtacgtttatgagtaacagttcgattaggatcgaaaaactgaacaacccatttttcactttcttgtacgcgctttattttcaaccctaacgccatttggtggtttaatgtgcatgctgataatgttctgacaaagtctccattttttttcatgttataaaaaaaattagtaataactgttccccactttttattttccacaaaataaatataagctggtgattttgaaaaatcttccgttttttccaaacatacattttttgcaatagcatcaggggtgctaagaagctgatagtttaccttcccatttgtttccataaaattcatttcccaataggaagctaggtgacggcaaactatttgtcttccatatatatcttttgccactccatttatatttaccttcacatttctcttttctgaaaaataaggtgctgttttattcttaaactgaattagttcactggagtttgagaccctcataatagaacttgttattgttctattatctctgttaacagacatatctgttgataacgaattttttgttgaaaatatactagatgaaaatgttttatttaacggcatagaagacaaccatagagatgttataatactattagattgcagttactaatagtaaaagcctccttacaaggaggtagcttattcagaatgctcctataagatagcgagctcgtcaacgatacagatgatctgattatattgtgcaaaaggagaacaggaaaataggcactggaaaagatgaaggcctgatgggagcattaactaatgcaaaatccgacaggttaatatcccgaaaagcaatcaaacgactcaaacaggagatgcacgctgaagtggtggacaactgttcggatttcagatgagtagctcagcagtttatgagccgaatgctctgtcacgggcaggaatcaggctgcatacgcagtgccaaatctaatcgtagttattctaaccagttttcaagctacaaggtggtgtagctggcatcttctctactctatcatcaaacgataaaatggttcctctcgtaacatttgctcttgcctttcacttccatctcgatcgcttcgtagttcattacgatagctgacatatttccagtcttcaggtctaacatctgacgccggatactccccgggagcgattttgcttcttaatagattagactcgagacacattataaattgtcgtattttatgaagtaataaagcactatattgcgagcattcctgatctgattttacatatagcgtaaactgagctcctatccccacacgagattgctgagaaactcgattcatatcagttatcttccatttatctataggactgtcctctgaaaataataaaccagacaaaatttggaatgccagaggaacttgctccctagctatactaatatgaaacttgtccccaacaaaatcccccttactctgaggattttcacgacatgcatgaataaacacatctccactatggttcacaatctggaatccttggtacatgacagaaaaaaattgacatatatcagagtaagttggcacgttcgatgctactttgaaatagtacgctgggtattgccgtatttggttgtacaatatattgaagttatttttcaatctttcattcgcagaaagcatctgcggtatttcagacttcacaacattcaaagaatctaaatttagttttagacagggcttttttatgggcatagaaaacgtcctctataaaatagatatattatcttatattgattgtttatcatcttttataaaacgatacattatatgtaatgtatgtaagcgtaagggtcttctccgatcatggtgggaaggcttagaacgccatattcagtttcccatagtggaacatcactcccagcttaaagcgctcccggttgcggtagcccttggcttttattctcagcagcctgatcttgctgttcagtgcttccgcatttccgtttgatacgccatggcgcatggcgttcaggataccgtacaaccttttccctatcgttttagccacactcttcatcatggggacgtcactgttggccgcagccatctctgccagtcgttgcgtctttcctcgctccatggtctgctccagatatcctttgccagttctttcagcgcccagcacaggctcgtcagcttcatctgcgcacgcagccatatcagcttttcctgcctggattcggtcatccatttatcgctgtgctgccacaggaagcgagttccctttgcctgacgacgactttcaacaggaagatgcggatgttcattctggcgggttttatccaccacctcacccggttgtttcgccacatgaaagcgatcgaaggctattttctcaaccgcattgggtaagtggatgcgcgctgctcttagtttgctgagccagtttagcattgccttctacatgaccgatgcctgagccggtataccgaactttattgtcctcaaccagtcatgttataagcaagaaatgcactcatcggatagagcgacataatctgaacctgcggacacatcttaagcggcttacccgcaaaaccatatgcttctcaaagtctgatgatatgcactacaagatcatcggctggtatctgacaatcaaccaccaccactaaatctgcgtcacgacctgcaactgagtctggttgaacaggctcaggccctgctgaagcaacgcgaacctctcgactcttgttggattttaccaaatagtttttctaaaattaaacacatttatataagttctttgctgaacaaaacgcagcccgccatcctttttcattcataaattcagcaatggcagataaaactttttcatcaagcatataaaaaataatgccagtagactcaatatgcctcatacaaataaggccgcacatatccgtaatatatttgtcaatgctgctaccatttgcatggtaatatgtcatgctattatctgatgattttacatatgcagtatgacatatttttccttcacgattaacaaaactgacaaaaccactttcaccaggagtaatatataaagatgaatttaacgtgcgctcactaatattcattaattgttgaaattcaatggaatagttttcagttaatgtatctattatcttggctttgtctttctttgttatctcattgtctttttcggcaagaaaaattgccactttatgacatgcattcagctcgttaattttacctgataaaactgcttttcttaccacatcgttgaactcatcgatagtgtgttttttattatatatatcatgaaaaatatagcctaaagacttaaacgagactttcattttatattctccttaaatattaacaggatatatatatatcacattttcctctatattttcagaaaccagctatcattttccccattactggtacgtcgcttcagatatttccgcagcaagcgataaccctgcgcactatgaggatgccattcattataatgtttgaacaccttcgcgagactactttactgctgttaacacgtcaggttcgaacataacactgatttaatcatatttcatcgttttgacgaagttttctgccattccattttgcaccgccgtgtgtttgggggcaaggccgaccatctgtgtttcattcgccagatataagtgatgagatggcattctccctccttcacggcagaagcattttgaccgtttaggggatgcggacgattttcatgcctgctaagatactttcgttactgatgctgtccgttttccaccatttcatcatcactgattggcgttgtgtttttggtcagcactccagctttacgtttctcttttaaccggtaactctctcctttgatattcagcgtgtagcagccgatctaggatcgctgttgccagcacgtgatctccgaacatttctccccagtctgcgacccctttgtttgacgtcagtatgatgctcgctttttcatatcgacagttcatcgataggaatttaaatccccaaaagattaaaaaagcaccgaagaatgcgcgtttattcaacacaacctgatcatcaagtaatcggtatagacacttaatattgcttacattgattgattcaatgtatctctgatggttttttgctccgtttccctcaacatggacggaacttcccctctgtgactctcagccgcaccaccgtattcgagccagcggctcatgcatcataacctgctctgccagacggtaacccctcttcagccccgtaaaccgcatctgacctccgcgcagcttgcacttcagcgggtcaaccttcagtcactgctgatacatccctctccttgtgatttgcctcgccgtttttctcactgtctccgttatggcgtacaccacatcttccagtaatcgccgcttcaccggactcaggaccccgtatcaccatccggaaccccttatccgccacatgccaggagaacctttccataaactcgtcgccactcatcacaaggttttcttctcgttttgtccggtggctgttgtaacgcaggccaatttcatcctgaccggcataatgttccaggcggctcatctgcaccggctgcttctccagccagttaagccatcggtttccctgctgaaaaatatcggcaaaacggggaagcatcagaaaggcggaataacgccatccggccagtgaaccgtaccgcattcagggcaatacatgccgtcggcgttgataccggcaggaattgtcgcaaattcccgctccatgcagcgggcaatttccggatacccttcgtcatcaacacgtacaaaccagaagaccagttttttgtttccggcatccacaaagaacggaatattcaggtctgcgcaacactcaacggcatcgtcaaaattatcaaagcgcagaacctcagcttcttcgtaaccggctcatttaaaccgtctggtctgtttcctccggctccacaaaaataatgtccgtcattttgaagtggacactatcgtatggaataccggacctggatcactgaagctttacgccttcatttcgaagaacatttaccacgggttgtagccggacgtcgcctgggcgtaccaaaatcaactgtctgtggtatgttcgtgcgcttccgcaacgctggcctttcatggcctctgcccgcaggtatgtcggagcaggaacttgatgcccttctttacggaagtgcctccacagtacctgtcgtacttactgaaagcaccgttatgcccaaactcccggtggtaaaaaaacgtccccggcggccttaatgccagtcagttaagcaactgactggctctttttcggggctgtggggtatttccagggcctctcctttaccactctcgggaaggcccttccccttctcgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctcagttgcatcgtctgttttatctccctgtatcccagttcgatttcccagcgattactgtacagatccgccatttctcctccggggaagcgcatggcgtccgtcatcgacgtcagcagatggcagacttttcctttgcgcgtcacggtcagcaggcgggctgtcacttcatttcccagtcccggccacttttttcgtgcctgcgggctggttttcagcttcaccagatgatcgcctttacccagttttctgagctcttcatattgcgctccctttctgagaggtatcatccagtggcggtgttctcccgccaggctccagccatttaacagtcccagtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggataccagatcaagagcctgtccaatgtgcataaaagaatccggaaacaagtgagcgtttccggattcttacacagccactggatcggtcaactgatccttaactgatcggcattacaccggcggcctaattttccttatgaatttaaaatcgctttagtggagcagtcactgcagcccggagcctgtgtggcgcagatcgcccgtgaaaacggaatcaacgataacctgctcttcaactggcgccatcaataccggaaaggtggcctgctgccttccggaaaaaatatgcctgcactgcttcccgtgacgttaacgccggagccggataataaaatcccggctccggcacaggaaccagagcagataaatacaccgtccgacagtctgtgctgtgagctggttctgccggccggaactctcaggcttaaaggtaaactgacgccggcgttattacagatacttatccgcgaaataaaagggagcagccactgatgatatctttccctgcaggttcgcgtatctggctggttgcaggtatcaccgatatgcgaaatggctttaacggcctggcctcaaaagttcagaacgtcctgaaggatgacccgttctccgggcatctgttcatcttccgcggacgccggggtgaccagataaaagtgttgtgggctgacagtgacggactgtgcctctttaccagacgcctggagcggggccgcttcgtctggccggtcacccgtgacggcaaggtgcaccttactccggcccagttatccatgcttcttgagggcatcgactggaaacacccgaaacgaacggaacgcgctggcatccgcatataacccgttgtaaagtgaggatatggacacctcacttgctcatgagaatgcccgcctgcgggcactgttgcagatgcaacaggacaccatccgccagatggcgaaatacaaccgcctgctctcacagcgggtggcggcttatgcttccgaaatcaaccggctgaaggcgctggttgcgaaactgcagcgcatgcagttcggtaaaagctcagaaaaacttcgcgcaaaaaccgaacggcagatactggaagcacaggagcgaatcagcgcacttcaggaagaaatggcggaaacgctgggtgagcaatatgacccggtactgccatctcccctgcgccagtcttcagcccgtaaaccgttacctgcctcacttccccgtgaaacccgggtcatccgtccggaagatgaatgctgcccggcctgtggtggcgaactcagttctctgggatgtgatgtgtcagagcagctggagcttatcagcagcgcctttaaggttatcgaaacacaacgtccgaaactggcctgttgccggtgtgaccatatcgtgcaggcaccggtgccttcaaaacccattgcacgcagttatgccggagcggggcttctggcccatgttgttgctggaaaatatgcagactatctgccgttataccgccagtcagaaatataccgtcgtcagggcgtggagctgagccgtgccacactggggcgctggacaggtgctgttgctgaactgctggaaccgctgtatgacatcctgcgccagtatgtgctgatgcccggtaaagtccatgccgatgatatccccgttccggtccaggagccgggcagcggtaaaacaaggactgcccggctgtgggtctacgttcgtgatgaccgtaacgccggttcggaaatgcctccggcggtctggttcgcgtactcaccggaccggaaaggtatccatccacagaatcatctagccggttacagcggagtgcttcaggccgatgcttacggtggttaccgggcgttgtacgaatccggcagaataacggaagccgcatgtatggctcatgtccggagaaaaatccacgatgtgcatgcaagagtgccaaccgacatcaccacggaagccctgcagcgtatcggtgaactgtatgccatcgaggcagaagtccggggatgttcagcagaacagcgtctggcggcaagaaaagccagagccgcgccactgatgcagtcactgtatgactggatacagcaacagatgaaaattcattcgctgaaaatggaatgtctccacggagaacactattatccatcgggaaatagtgcgggcaacagtgtttagttatatcgagtgcgattacaatcgctggcgacggcaccgttggtgtggtggtctcagtccggaacaatttgaaaaccagagcctcacttacgactgtgtccatattatgtgggtaggatcaataaagacgttttatatgtgtctgcttgcagccagaaaatttataccctgcaggtatcataaacatgcttgacaacttaattagggccccctcttccttttatggtgtaattgtttgattgaatacttccggggatttcagtatgaaatgaagtatatttaatatactttacaaaaagtttgtattagtggaataagaacaatagtttatccaaactgccaagcccctttattataagtaagatctggcactggaatattctcaaaaggactaacatcatcaccacgaccttcaaccaaccataaaaaacaatactattttaggtgatgtattaaattagtagaatatttattcttctataaaagcactaccccaagaggttaatcaggtcatccatgattatttatcatatactaactatgtgggatttcaacgtgaaaacttattttcactataatcttcaggattcgaagatcataggagcctgtacataagtttgtataattctctgatgttgaactatttaatttgatatcaaatgaaggtgaatttatgaatgaaaaacagttgacatctaataagttgcgggctttagctaatgaactagccaaaagtctcaaaaatcctgaagatctcagtcagtttgattggatgctgaaaatgaaaccgtactcaatgctaatatgactcatcatcttgggtgcgagaaaaatcagcttagatctggcagcaattcccgcaatggttgcttaacgaagattatcactactggagatgaacctctggaaatccgtactctgcgtgatcgtaatggcactttcgaaccgcaacagctgaagaaaaaccagccctagattactaaatttgtcgggcgatggattaactggttcaggctgtctggtgctgaaggcctgaagtcactgctgtcagtgatgtggccggctcttcatgagacaataacccgtaatcatcagtgccgttcaatatggccactgttgaaaaaagttcgtcactttatggagacggttagcccacttcccggagaaaaacatagtctggacaaagtgtagcggtattaggctcacatatttagatgtagataagccggagctggcagttaaatctaggcagcatcacagaaatggacaacgccccttaaggactggcgtatggcaatgagctgctttattatcaagtttggtgatcgccttgacggtcacttctgagtgaaggcgcttgcacagaatggtaaacggactcgattattgaatcttagggataagatatatctacgatatgtcaatatacgaaatcgaaagaatttattggtgaatatagccattcaatgtggcaatggtttttttagattagcaatagactaatatctattacattacaaaaataggttattgttttttttagcaaaaaggatgaacaaaaatgtcaataaataactatggattacatccagcaaacaacaaaaatatgcacctaataataggcagcaatactgctaatgaaaataaaggaatgaaaaataatatcattaacgtgacaaataccgctatatcccacgccatcaatgaagaaaaatcaggggggggatatagtggtgtttctttcagaaaattggccaaaatacagaacatatccattccgacaaagaataataaggagtataaccgccataatttgttttcattgatttggcatggaaatgccgatgcagcgcgtaaatacagtgaatcgctgttggcagccgaaatacccaaagaggaaaaactagaagttcttgcagcacgaaataatgctggggaatctgctttgttcatagctcttcaagaaggtcattccgctgcgattcaagcttatggagattttattaaaacttttgatttatcaccaaaagaaacgattaaactattggatgtaagagataatgaggggttaccaggattatttctggccgcagggaaagggaatatcgaggctatgatggcatatataaatatatgccatcatagtgggataaaacttacagaaatagcagacagacttaacaataatgaacaagacatgtttaatattatttctgacaaaatacaagagttgttttaagtgtgctaaatagctgcaaagaattgcacttagaaggatctctccccgaattgtgtgatctgcttaatttctaaaaagaaacaaacagttaactagactgagcgatactacccatagaaccagtttcccatgacgaacgacactggacgcaaaaacaatcataaaaaacacaataaatgtaatgaacacatcccaccctattaagtaaagtgcactgtgatagaggaagggaaatacaggaaggtgtggagccttgcagatttctggcatcatagtgcccaatacggaatgcataaagccccctcagactggagactccacaaatgaaatatacagtgtttaattatatcaagtgcgattacaatcgctgacgacggcacagttggtgtggaggtctcagtcctgaacaatttgaaaaccagaacctcacttaagcctgtgttcatattacgtgggtaggatcatacttttatagaagctgtcagcggctacgtcccagccaaatcacttcatgctccagcgccagagaggcaaggttgggtttgctcagctgccggttgattttgttgcgattgaaccggacagcgtccagggcgtcggcaaaagagcgaatctcaccaatcgttgtttcattatccgcattaacgatagcttcaagaaacgccaaggttttatcgaattcatcagcaacagtggctccgggcataccgtgaccgtttatacaaaacggcgttttcagcgtggagttttcatgaatagcctcaacacgaatgtcgtgaagccagtgatgtatcggctacgatcctcagctgatgccagaccataggactgacactacgaacagcaattttaatgacgtaaatcttcataactacaactaacagggcatcattatgaatgatgccggttattttaccgctgttggtcccttcatttagggactgccccaagttttttcatactctctttctcagagagtttagtctctgggattccagacggtccatcattgagccaagggagtaaagaactcaaagcatttacagaattgtttgaatcagctaaaataatgacaatgttactattttacatgacaaggtgattataatgcttggaacatcttttaataattttggaatcagtttatctcacaaaagatatttttcaggaaaggtggatgagattatccgctgtacaatggggaaaaggatagtaaaaatatcatcaaccaaaataaatactagtattttgagctctgtttcagaacaaatcggtgaaaatattacagattggaaaaatgatgaaaaaaaagtctacgtatcccgggtggtaaaccaatgtattgataagttttgtgcagaacacagccgaaaaatcggcgataatctccgtaaacagatatttaaacaggttgagaaagattatcgcatttctctagacatcaatgctgcacaaagttccataaatcatcttgtatcaggaagcagttatttcaaaaagaaaatggacgaactttgtgaagggatgaatagaagcgttaaaaatgatacaacaagcaatgttgcaaatcttatttccgatcagttttttgagaaaaatgtgcaatatattgatctaaagaaattacgtgggaatatgagtgactatattacaaatttagaatcgcctttctgatgacagaacatcccgagtaaagaaactaagaaaagtaaatacccaggaattgcctgagcggtgctatatttctcctcgcaagtaagtcctaatatattgaattgttgtatagccagtttttgtattttcctagctcatggatgtgggatccctctcccctttctctgctcaaaggtaagcggctcgtcagaatcatattgatatttactgagaagtcagatcaactttccaaggcaacagatcgcgtacccggtttgccggtcagtcctggatatgttcaataacgtaacgcagccatttttctggctccacattgttcagacggcatgtgccgatcagcgagaacaacaccgctgcatgttcgtcaccgctgtcggaacctgcgagtcgagtcagccggagagagtttcactctccggctgcttacggaaccgtacgtgacactctcgcgtcatacggctcttgatcactcattcgatgcacgtagtaaataccagtgagcaaattgatcttacccagcaatacggtcagttaccgcgcacatggcctgcctgtgtcagaaaatctgctggagcaggatttttacgccagtggtccgaaccagaagtgggcgggagacatcacgtacttacgtacagatgaaggctggctgtatctggctgtggtcattgacctgtggtcacgtgccgttattggctggtccatgtcaccacgcctgacggcgcaactggcctgcgatgccctgcagatggcgctgtggcggcgtaagagaccccggaacgttatcgttcactcggaccgaggaagtcagtactgttcagcagattatcaggcgctgctgaagtggcataatctgcgtggcagtatgagcgcaaagggctgctgctacgataatgcctgcgtggaaagcttctttcattcgctgaaagtggaatgtctccacggagaacactttatcagccgggaaataatgcgggcaacagtgtttaattatatcgaatgtgattacaatcgctggcgacggcacagttggtgtggcggcctcagtctggaacaatttgaaaaccagaacctcgcttaggcctgtgtccatattacgtgggtaggatcacttacgccctgtggttgaaacgtgagcatattgttttcagatgctgttgtcttgcttcagagtgatctgtcctccggatttacgcaaagttatccacaggcactgtgcatttaaaaaacttatcttttcttcttgattttaaaaactcagatcgtcatatcattatgataaacataataaaaaactctaaacatgagaaggtttttaacgtaaggtgagaggatttttaagtgtatccatagattaaaaatgacaatgcctccaattagttgaattaggggttataatacccgcttttaggttctttcatggtcacagttaactttcattgcccccgttgccagtccgttcaggtttaccgtcacgggcagaacccaaaaggacatgatcgattccgttgccgtgactgtcaccgggtgtttcagctcacttactgttacgaggcccgtaaaccgggagttaaaaaccaaatcactgaaatggctttcaacggtgccggagttcgcgatactgcccgtacgctgaaaatcggcatcaataccgtcatacggacattaaaaagctcccgccccggcggataacatctgcgccagtcgctcacgctgatgttgcccttatctgtgaacttgatgggcagtggagcttcgttggcagcaaggcgcaacaacactgtcacgaacggtgcaatagtgatccacacccaacgcctgaaatcagatccagggggtaatctgctctcctgattcaggagagcttatggtcacttttgagacagttatggaaattaaaatcctgcacaagcagggaatgagtagccggacgattgccagagaactggggctctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttcccggatacagccgaatgttgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcaggctgagggatccccacaaaattactgctaataaaccagcaccatatttcggtaggttctggacagatggtttagaactgtgctcagtactgttcgtcttaaaataagtggcgagtgtcgaagaacattcttcgctaacgtcagatatgagataacccgccgggatttaatgctgttagcctgatatttcaggtgtaaccctttattttcagcgtgataaccgagtaaccacattacgatagtgctcaacgttgccagcagactcagaaccagaattcttcctgttgaacgacttttgctggcccgaagaccaaatccgaagcgcccgttcttttcatcacgaaagttttgctctatctgcattcgccgactgtataacttgatgatttctcgcgctctgaagtcatttgtactgctgaagatcaaccaggcttcttttgctgatttgctctgttctttgtctgttttgtttaaaccactctgacctttcgaacgtttcttttttcgcccttttgccgatttcttataggtgtaaaaatgcccccggatgctttttttcctttctttaaccagccttccagcccccatatattccggtgttttacattcagggctatccgacacttttaaccatctttcaggcgcgttatcgaggcaatactgaacgttatttctgatccgaccaataaaatcccagcccagagaagtaatatggtgaaaccatgcgctctgaaatccagcatccgtgacaataataaccctggcatcggggggcagggattgagcaagggaatcaaggaaatcatgttgtatcaatggattattttgtttttcagaaggaacaaccttactcaataacggaatggaacgcccgtcacacagaaggctggcacgaagaacatgatgctcctgggagggatagccactccagtctacggctattacacataaagataactgccgtgtcagcattgaagtgatattcctgaaaatcattggaatatcgcgatggagcgcctcattacccatgaggcgatcaatacgtttgatcttattcttaacttgtgcattacccggcaaaaaacgtccgatactggtctgcgtcagagatgctccgttgattaacgccattgtggcatccatcagggcattttgtcggtactgatgaaatggtgctaaggcatcccggaagaaattctgacatactttatgaacaggcatagcagtgatctcattgaattgttggcacaaatcagtagatcacataatgctatgtttgtctcgttttctggggattcctcagcccttcagggcacagactaaaggtaaggtggaacggatggtgcagtacacccgtaacagtttttacatcccactaatgactcgcctgcgcccgatggggagcactgtcgatgttgaaacagccaaccgccacggtctgcgctggctgcacgatgtcgctaaccaacgaaagcatgaaacaatccaggcccgtccctgtgatcgctggctcgaagagcagcagtccatgctggcactgcctccggagaaaaaagagtatgacgtgcatcctggtgaaaatctggtgagcttcgacaaccccccccagcatcatccactctccatctacgactcattctgcagaggagtggcgtgatgatggaactgcaacatcaacgactgatggcgctcgccgggcagttgcaactggaaagccttataagcgcaggcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaaactgttcttccaggtcatcgctaaacgttacgaaaagagcgcaatgatcctgacatccaatctaccgttcgggcagtgggatcaaacgttcgccggtgatgcagcactgacctcagcgatgctgggccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacacaacactggctctggtatgcgtacaacactaaaactggcggtgtgttggcttacactttcgggccacggaatgatgagacctgtcgggaactgttagccctgttgactccgttctgtatcggcatggtgaccagcgatgactggggcagctacgccagagaagtgccgaaggagaaacacctgaccggcaaaatcttcacgcaacgtattgcacgtaacaaccggaccctccgcacccgcatcaagcggctggcacgtaaaacaatctgcttctcgcgttccgtggaaatccacgaaaaagtcatcggctccttcattgaaaagcacatgttctactgattggaagcactacccccgcctgttgcgacagtcacgtcatcgccgtccgttaccggaacatgtttcccgcgaaatacaccatctggagcctgaagaaagctgttgtccggagtgtggtggtgaactggattattcgggggaaatcagcgtctttctcccggaaaggcatactatcttacagtaatattcattccgatgattaataaatcagcaatgcgcgcatttttaatataagcatgtacaatatgtacttgcatgcattaccctgctaatgcagttttttttgtaataagttaaaatcctacatagcacggagggggaatgactagttttgagcagttaagtaaggttgcgcagcgtgcagataaaatgttgctcgccctaacaaaacagattcaggagcaaaagcaggagtttcaggctgatgttttttatcaagtctattcaaagtctgctgtagctaagcttccaaaattaacgcgcgcaagcgtcgatggtgcagtcggtgagatggaggctcagggctatcagtttgaaaaacgcccagcaggaaccgcgacaaaatatgcattaaccatccagaacattatcgatatctatgcacatcgtggcattcctaaatatcgcgatcgttatagtgaggcatattccatattcatcggtagtctaaaaggcggtgtgtctaaaaccgtgagtagtgtttccgtagctcacgccctgcgtgctcatcctcacctgctgtcagaagatttacgtattctgctccttgatttagatccccagtcatcagccactatgtttctgaactacttgcatgcggtggggctggttgatacaactgcaccgcaggctatgttgcagaacgtgagtcgtgaggaattactggaagattttatcgttccgtcagttatccctggcgtttatgttatgccggcttctattgacgacgcctttattgcatcaaactgggatactctgtgcgaggagcatctattaggacaaaacaaacacgcgatattgcgtgagaatattattgataagctgaagcatgatttcgacttcatccttattgatacaggcccgcatctggacgcatttttgaaaaatgccattgctgccgcagatatcatgtttacaccggtgccgccagcacaagttgatttccattccacgcttaaatatttggctcgtttacctgaacttgtacagattattgaacaggatggatgttcatgccgtttgcaggcaaatattggcttcatgtcgaaactggcgaataagtcagatcataaatactgccatagcctgacaaaagagattttcggtggtgacatgcttgatgtttcaatgccacgtcttgatggttttgagagaagcggcgagtcgtttgataccgtgatatctgcgaatcctgttacttatgttggcagtggtgaagctttgaaaaatgcacgtatggcagcagaagatttcgctaaagcagtttttgatcgtattgaatttataagggccaactactgatggaaaacagaaagcaccgaccgactattggccgtacgctgaatacaaatatcctgaataatactgaagaaatatcggctccagttcatgtatttaccctcaatactggccgaaaggcaaaatttactgagatcaaggttgatcatgacaaagtggacactcaaacttttgtggttgaagaggtgaatggccgcgaacagacagccctgacgccggactcactaaaagacatcaccagaactatacgtttacaacaattctatccatgtattgggattcggactggcgatcttattgagattttggatggttcccgtcgtcgggcagcagctttgctatgcaaggttggattacgtgtacttgtaacggatgatgagcttactgtttctgaagctcagcatctggcgaaagatttgcagacgtcacttgaacataatattcgtgaaattgggttgcgtttagtacgtctcaaagaggccggtatgaaccagaagcaaattgcggaaagagagggattgtcggcagctaaggtgactcgtgccctccaagcagcgtccgtacctaaagattttgtgtctctttttcctgttcagtctgagctgacatacgccgattacaggcaactggctgaattaagtgaacgactgaggctgggtgatatatctattgatgaagttgtgaagaatatctcgccgagtattgagcttattactgctgatgacaatctttctgaagacgaggttaaaaacagtattatgcggcttataaccaaggaaatgtcttcattgcttgattcaggagtaaaggataaagcggttgtaactttgttatggaaatttgatagtaaagataaatttgctcgaaaacgagtaaagggacgtacgttctcatatgaattcggcagattaccgttggaagttcaggataagttagatcgtatgattgctcttgtactaaaagataatctgaattcgctgtgaaaattcaagtttttcgccagcaactcaccagtttttaattggctgttttaaaagaaattttgcttttattagcgttttttttgaacagtatttcacggtgaaatcgcctgtttcaccgtatcttctttgcttgaaaaagatagtttctcttagccgtttaacagtaaccgatgagatagtcttccccctctttcacggcagccttcaattgcgccatgatggataaactttaacaacaaaagtaagcgggataccatgtctgaacagaaaatcaccggcattgatctggctaaaacgaacttttatcttttcagtatcaatgctcatggcaaacccgcaggaaagaccaaactttctcgcaatcaactgcttaactggctggtgcaacagcctaaaatgactgttgcgatggaggctggcggggcatctcattactgggcccgggaaatcaggaaactcgaccatgatgtaatattgcttccggcacaacatgttaaagcttatcagcggtgccagaaaaatgattataacgacgcacaggcaatagctgaggcctgccaacatggaactatacgacccgtaccaatactctggagcaacaggacgtccagacttttttgaatatgcgtcggttggtttcaatggaaaggacacaactgataaatcacattcgtggacttcttgctgaatacggcattgtgttcagtaaaggcgcagcagaattacgccaaaagtaagcggctcgtcagaaccgtattgatatttactgagagctcagatcaactttccagggcaacagatcacgtacccggtttgccggccagtcctggatatgctcaatgacgtaacgcagccatttttctggttccacattgttcagacggcatgtgccgatcagcgagtacaacaccgccgcatgttcgtcatcgctgtcggaacccgcgagtcgagtcagccggagagaatttcactccccggctgctcacggaaccgtacgtgacactctcgcgtcatacggctcttgatcactcatttgatgcacgtagtaaataccagtgaacaaatagcttcggatactccttccttaccagcgtcagctttcgctgagccttccggttcgaaagtctgtatttagactgcatccacttgagcagacgtgactgcattgcactccacagtcgatagttgaaatttctggaccagaactttccgtagtactcgatccagcctctcactatcgcattgtagcgcctcgcaaaatccagcaaactctcagctgttgagcgatgtatacgccacttcttgattgtttctgttattttgcgcattgctgcatttgacgcacccggcatgcattttcggtaccgttcgcctttgaaattcttcagcgtacgcactttgaagtcatatccgagaaaggtgaaactcgttgcgacgtttctccttttaaacgtgtcaatgtaggcgatattcgttttccctgcattcaggagcagcccgacttccgagaagcgctccgataacctgttctttagccttgttgcatcactcattcgtgaacaatgtactacaatatcgtcagcgtacctctcaaacggtaccccccgatattctctttccatccacaaatcaaatgcatagtgaaggaacaagttagcaagtagcggactaatgaccccgccctgcggagtgcctcgtgttcgggttattaattctccattttcacaactctgcattggcgcttccatccagcgtcgacagtacaggatgacccatttaggcatcccgtggtgttccagagctttgagcaccagatcatgtctcacatggtcgaaaaacgcactgatgtccacttccagtatccagctataacgccagcaccggatggcacattgtttcagagcgtcatgagctgatttgcctggtcggtaaccatatgaatcagcatggaaaatcgggtcaagcttttcttccatgaaaagttttatcgctccctgagcaattcgatcggatactgttgggatccccagaatgcgttccttgccattcgacttcgggatccgtttttccagcactggtggcggaaaccatgttcccgaacatagccggttccagatcttgtatagattgccatcacgttgctggtcgaacattttcaaagtctgcccgtcgcatccggggggctcccttgttgcgacgcacatccagatatgatgcccagaccagtgcttttggtatttcaaatgattttcgttgcatcagttacgtcatccccttttgggttgtgtcttctgcaatgaatgtgatccccatcccttcgctccagacccattacagatctttcatcactactacgaatgggtccgcccctgtttcccgatacgtgccggaaacaggttctcacgttccctgagatggtctggcccgggatcctgctgccttcacaccggatgccgcgcagtcagtaagcaggtgtcttctgcgcttatcaggggacggctgtacggccccattttggcatcatctaagatttcgatgcttcatcggacagtttactttcgttcagcttcccgaaccccacgtgacagtagatctctgccttttcccgagtcgctcaccacctcattccttagaatgaagcagcaccgggtcgtttggtctgtgctcctgtaaaccctgaccggagggcccacctccacccacctcagagcatggataacttatgctgcaatttccgaaccggcgttacggtcatcacgaacgtagacccacagccgggcagtccttgttttaccgctgcccggctcctggaccggaacggggatatcatcggcatggactttaccgggcatcagcacatactggcgcaggatgtcatacagcggttccagcagttcagcaactgaaccgccccgggtttcctggagagtgttttatctgtgaactcaggctgccagatcatcgtttccgatggaagcataataagctttttctgcttctgccggagggatgtggcccagcctttccagcaatcgtcgattattataccagtccacccacgtgagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgcatccggcaaacacatcaatgatgaacgccacatagacgaagccctgccatgtgctgacataagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgggcactgcgtttatccggatgatgtcgctgttgctgacagtggtaatacgttgacggggcaatatgcagttcactgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccggctctttcagacgctgacgttcagcggtggtgagccctccatcaccgcccccggtatcccgctcatgctggcgaacccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcattaagctttttgaatgcctgatcgagcatattctcgaccatgttcatcactggtctttccgaaaggctgtaagaaataacttcgttgttgaagagatctattactggagacaaatacagcttgcgcccattgactgcaaattcagtaaaatcggtaacccacttctcgtttggccgcgtagccttgaaatctcgttggagaacatagggggcggtttgccctacctctcctctgtaagagcggtatcgcttgaccttaatcgctgccttaagtgagaggattcccatcaggcgctgaaccacggcagcctgacggctgcaaattgaaaaccgcccctgttcgtcctgttgttgccgcacgctccgcagaatatgtatgctctgaggacctgttttattaaggactcatcctcttatgttgacccgcaaaagtatagataccgttctgctctctgttggtgctgagaagctctcacaacgtgaatgggactggatgaagatgctcaaacccatggacccaccacctgcgatggtcgcggcctccatcctggagcgccgtggcgacacagcagcccttacccggctacaggataccgggggttaatccgtcctcatgttgtccgcttttactccccgcccgctgaaacgtctgttcacaaccaaccagtgctggacatccttcctggatgcgggcggtctgcgcgatatcgaggttgaggctgtcacaaaaatgctggcctgcggcacgcggatactgggcgtgaaggaatacaactgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcatcctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgtggacagcggtatcgtctggtttttcaatttcctatacgtgaacagttttatggttaatctgtttcccttctcgatgaagagacagcgttaccctacggtatccgtatcggcctctattctcatgataaatctcaccaatacgctttttaacgtccgcatacttgtcaggcttgctgagagcctttagatggtaataaaacgtactgcgcggtatctccgtagccctgagaagctcatcaagaggataaaactgccttagctcgttgagtactttcactttttcgtgggatgagctaaggctttcagcttttttagatacacaagccgcgtttcaagaaatcgaacttgcctttcaagatcctcaatgcgtcggtcttttgacagctccaatgctgatgccgctttttctggatcaactgatattgcaatgtttcttttggtgccaatcttgagcgcgcgtaaaccagcttctccgcgctcttcataaaccttcagccacctggctacagaaccactaccagcaagcataaagtgagcagcagcctgattaagggacatgtgctgctcaatcacagctttcacgaccttaatacgcaactctggatcagcactaacacctttaggtttgggaattaagcctttttctccatgtttttcatagagggcaacccatgtcctgacctgggttcgggggacaccaaaacgtgccgagatgatcctgtaaccatcatcagtagtgaagtagtgattcacgacttcaaggcgcttttcaaaagggtattttggctttgacatatcaggggctattccatttcatcgtccaacaaaatgggtgcagtacataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcatttaaaattttttatgatataagtaaaatttctttggagttataccataatattcattaaatttccttataaaataagatgggcttgatattccgataagtcttgatacatcattaatatagctttgactattcaataaaagctttgctgcatgatgcatgcgaatatcaagaaggatttgttgaaatgttaatttttcactctccaatcgttttctaacagctatttctgataaattcaagttatttgaaatatcagaaagacgccatctcttctcgatgtttttttcaacaatcttccttatctgatcagaaaaactaagagaagaagctatcgatatcgaagtatataaagcttcctcatcagaaacagctgataaaaggcaagctaaactatagatctttcttttgccgaaaggcatctcttttatagatttgaacaaatcgatagaaacctcctcctcagagaggaggaatatttttttgtttaacccccttttctcctcagaataggagtgttgaaatgaataaattggttccattattctaataatgcttaataataaatttctgtcaaggcttataatctcaaatggattaatgctatcagatttttttatggagacgtttatttgtatatttcgctctataaaagcaatttgcccttcatcgatagtcaaagtttcattgcctgagctaaccgtcattgaacacctttttgcatataaaataatatagttatgcaagcgaacctttatatctattttgtttttatgtcccatatccatcataaattcaacagaatataccaaactatatttagtgtttacagagtaactaagaaatttctgtaacagtgattgtatacaaaatctttccgttattaagatagattaagtaatttttcctatatttaactttatttacattttttgaagaaagagcttatgcagcttctatttctctgtgcaacaagctaagtatttgcactgaaagggactataaccatattatggtttcacttttcttaggcaatatctgtgtaaatgttcggaaaggagtggagcttcgcaaaactccagcatcataatatcctatacggaacgcataaagccccttcagactggaggctccacaaatccggttggtgttgatattggtaagcgttaaccgaatgccgcattgacgattctcccgatgacagcgttacgttccatattgcgatcgtgaagccatagactgggcagcaggcacgggagattatgacaaagcaacggtgcaggatgtcatgtcaggagcgatatggcgataaaggaccggaacggccaatccagtggccgataacggttcggcttatacggctcatgaaacacggcagttcgccagagagttgaatctggagccctgcacgacggcagtcagtagccctcagagtaatggaatagcagaacggttcatgaaaacgatgaaggaagactgcatcgcgttcatgccgaaaccaagaacggcattgcataaccttgcagtggcgatcgagcattacaatgaaaaccatccgcatagtgcgttgggttatctctcaccaagggaatatcgacgtcagcgggtaatgtcaacttaagatacaacgactgtctgaatatcgtgggtcaaggacagttcaatgacgtaacgcagccatttttctggctccacatctcatcgcttacgaaaaaagtatcgtttttttacagtaaacttcatttagccgactataatgtaaaaaataaattctttactaaaatataacataaggaagcaatatgcttacacaaactatattcccttgccttccacaaaaacaagaaaatatcatccttgaagtatcaaatcctgtattattatcttctactgttactacagatggatatactgttttcaataaaaaagcagctatatacgaattacaaatacctgctgccaaccggacgaaaacgttgaaattcactgctacagaaatgcaatggttgacaaagataaatgaagccggaattgatgaaaaacaaagccaacggtattctgatttctgaagttaatttcagactcgtttaagctccattttcaaaagaatatatcagggtttgttactaataatttctggaaacagaaaaagtagagcagtaattctatttcagagaggagtaactccatctatcctcgatacggtaatgctgccaacttattgatttagtgtatgatggtgattttaaggtgcttgcgtagcttccatttccatcagatgtccttcctgctccgctactgaaggcgtggtgcgtaacggcaaaagcactgccggacatcagcgcaatctctgctctcattgccgtaaaacatggcaactacagttcacttacaccgcctctcagcccggtacgcacaagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccctcgatacatactgaacgttatcgtgatatatttatcatgctttcttcaccattattcgagtgcagggacgcaatgaccttaaataccttttagtagaatatattgctgacccacaaatatcaggatggtattgacaagtcatagatggagaaatatatgactgaattaccattctctggaataacagcagactccttcccatagacggcttaggggggtgcccctattaagttgtcaagcatgttatgacccctgcggggtataaaaagtcccgtcgcgcatcatggcgaacagaacgtcgcagcgtcgtctcgccagggcgataagcgcctgattgtgtcgttttccctgactcattttgcgggtgtagtaagccctggagagcggatccctgagcgcggtgaaggccgacaggaacaacgcccgtttgagagctttattaccccgtcgcgagggatgctcaccgcgtattgacgagccggatcgccgagttaccggcgcaaggccagcataagcagcgagatgtgcggcagaggcgaaggcgcggcaggcgacctcggtgaggagtctggctgcggtcctgacaccgactccgggcatactggtcaggaccgggtaaagagggtgagcaagaactcgctgttctacctcaagcgccacctcgtctctttgcttacgcagcgtgatgagctggagtgccagacgtggcagtactacggcagcggcattcgtgccgggaacgacgacggtttgttcggccagtgcctgagctatgtctgctgcaaggcgtttacccagacgaggcgcaagtttgcagagctgggctgccagcttcttctcacccagcgaagcgagtttttctggtgagggatatcgctggagaagatcgagtaacgccgggtgcacaagtctcggaccgagaacgcgctccggtgccggatgtatctgggtcagaaggccgcggatacggttgctggcctgcgttgtctgtgcggcaagatcatcatcgaagccgcagagcatggagagttcggcgatttgctcgtcagccagtttcagcgtgcgtagcgcgtgaggcagggtacgggcagcttcggcaatgatggcagcgtcacgagcatcagttttagcttcaccggcgtgtaagtcggctatgcggcgcatggccagtccagggaggtatccgacaaggactccttctgagcgggcaacggcgacaggtaacgcaccgatggtagctggctgatcaacaaccagcagtatctgaccatgttgtttcaggtcagatattagcgacctgagtttgttttcgtcgttgggtaatgctttatcgaacaggcgtttacctgaacgattaatggcaacagcgtgatgcgtatctttaccgacatcaacgccgataaagacctggacggattcgcaatcgctggattcggtcattctgtctcccttgtatatgggttaaccagataaccacggagagcaggtaccggcatccacgttacagacggtcccggcaaaagtgcctgacctgacccctattagcggttaccagcgccccaccagacccggtgacatcaccccccggatcatggacgactgggggcagtaatcatgccgggtctggctggctaacaccccattataaggggtacgaataaagtaacgggggaagcaatacctggagaaagagtacaaagcaaactgtattaaacttaataagttatattgtatttcactagagttcttatcgttgataagaaattctggttataatgattaaatcaacaaatatacaggtaatcggttctggtattatgcatcaaataaacaacatacactcgttaactctattttctttgcctgtgagtttgagtccatcttgtaatgaatattatttaaaagtctggagtgaatgggaaaagaacggtaccccaggcgagcaacgcaatatcgccttcaataggctgaaaatatgtttacaaaatcaagaggcagaattaaatttatctgagttagatttaaaaacattaccagatttaccgcctcagataacaacactggaaataagaaaaaacctattaacacatctccctgatttaccaccaatgcttaaggtaatacatgctcaatttaatcaactggaaagcttacctgccttacccgagacgttagaagagcttaatgcgggtgataacaagataaaagaattaccatttcttcctgaaaatctaactcatttacgggttcataataaccgattgcatattctgccactattgccaccggaactaaaattactggtagtttctggaaacagattagacagcattcccccctttccagataagcttgaagggctggctctggctaataattttatagaacaactaccggaattaccttttagtatgaacagggctgtgctaatgaataataatctgacaacacttccggaaagtgtcctgagattagctcagaatgccttcgtaaatgttgcaggtaatccattgtctggccataccatgcgtacactacaacaaataaccaccggaccagattattctggtcctcgaatatttttctctatgggaaattctgccacaatttccgctccagaacactccctggctgatgccgtgacagcatggttcccggaaaacaaacaatctgatgtatcacagatatggcatgcttttgaacatgaagagcatgccaacaccttttccgcgttccttgaccgcctttccgataccgtctctgcacgcaatacctccggattccgtgaacaggtcgctgcatggctggaaaaactcagtgcctctgcggagcttcgacagcagtctttcgctgttgctgctgatgccactgagagctgtgaggaccgtgtcgcgctcacatggaacaatctccggaaaaccctcctggtccatcaggcatcagaaggccttttcgataatgataccggcgctctgctctccctgggcagggaaatgttccgcctcgaaattctggaggacattgcccgggataaagtcagaactctccattttgtggatgagatagaagtctacctggccttccagaccatgctcgcagagaaacttcagctctccactgccgtgaaggaaatgcgtttctatggcgtgtcgggagtgacagcaaatgacctccgcactgccgaagctatggtcagaagccgtgaagagaatgaatttacggactggttctccctctggggaccatggcatgctgtactgaagcgtacggaagctgaccgctgggcgcaggcagaagagcagaagtatgagatgctggagaatgagtactctcagagggtggctgaccggctgaaagcatcaggtctgagcggtgatgcggatgcggagagggaagccggtgcacaggtgatgcgtgagactgaacagcagatttaccgtcagttgactgacgaggtactggccctgcgattgtctgaaaacggctcaaatcatatcgcataacccactgataatgtttactaccggatgtagcttttttcatgcccgagatggtcagttagttccgcattaagcaccgtttcgacagttaatttcgtctgcatacgggaaaactgattgaggtcggcctcggttttgaggcctttagccagttcagccgcaagggctttaagcttcttttcgtccataatttacctgtctccgttgttggagtgaaccacggcagcctgacggctgcaaattgaaaaccgcccctgttcgtcctgttgttgccgcacgctccgcagaatatgtatgctctgaggacctgttttattaaggactcatcctcttatgttgacccgcaaaagtatagataccgttctgctctctgttggtgctgagaagctctcacaacgtgaatgggactggatgaagatgctcaaacccatggacccaccacctgcgatggtcgcggcctccatcctggagcgccgtggcgacacagcagcccttacccggctacaggataccgggggttaatccgtcctcatgttgtccgcttttactccccgcccgctgaaacgtctgttcacaaccaaccagtgctggacatccttcctggatgcgggcggtctgcgcgatatcgaggttgaggctgtcacaaaaatgctggcctgcggcacgcggatactgggcgtgaaggaatacaactgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcatcctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgcgggagtcagatgcgttttacggggctgaagcggggctaccgtctggcagagcaggtcctgatgcatgagccgctggcccggatgcggtggtgcggctgagagccgcagaggggaagttgcgtccattttgagggaaacggagcaaaaaaccgccattcataccctgaatcaatcagagccatccagtttaatcgtcggttccgttcatatggagcaaaagtggtgttgaagaaacatccgttttgtggtgtttttttaatctttttggggttttaattcctatcgctcaagtcttaacgatatccctgaaacgaccacttaatattactcacacttttgcaaatgcattaaatgctgcttgtattattctgatgccgcgccagcggcatggaaggcggcacgctgtggttacatgtgataccggagtaaaaccgccgaagcccggcgtcagccggtactgattgacagatttcaccttacccatcccccagccctgccaagccatacccgttttcagccatgatagagcttctgtgcgcggtcggagtggtcccgacgagggttttacccgaagtcggggcgtatctccgcgttagcgggccgtgagggccgcttacgagcgtgtactcgatacgtccagccagaagactgacagcgatgatgctgtagttacaacattcataattaaaagcgactctgttcccgccctttgggcgggggcggcggcgcttttcagttatgagggggggcgttgtggtttcagttctgcgttggacttgggttttttaggggtttatgtttgcatgttgtaactaaaccggcttcggttggggcccgccgcttgcggtgggaggtgcatatctgtctgtccacaggacaggcagtgaacaagttttctttttaaatgaatgtaattaagtagtttaaaggagatataaacaggtgtttaaaagatacattgcaccctgtagggttgacgtctggcgctttatgacgtgaacggttgtaaccttatggtgaagtcccttgcagtttaatgtggataagcaaaattccccgtctgtgaggcgtgttttgtatcaaaaacaggggggaccggatgcaccagaaggtggatgatgaggttgttttttgtatgtagcgctgattttttgtgcactggcgggcttcaggcgtgcgaatgcctccggcgcgtgccggattattctgaggaggtcactttcagggggaagctgtggccagccggctgtaattacggttacgtgacagaatcatgcgctccttcacacgacgctccacttcacgttttaccgcctcacgactggcagtgaagcgcccttccgagatttcacgcgtcagttgccgtttcaccagggtgacaatatcctgacgctgcctgtccgcatcacgacgcgcacgggcacgcttcattccacgggacttaagctctgtctggtaactgcggaaacgctcacgaacaaaacgccaggctttcgccatcagttcatccatacccagggtatccagcccctgctttttgcgctgtctgttttcccattccacacgactgcggcgcgcggcggccactgcctcctctgatacatcgagggcagcaaacagtgcagatgtgaacgtgatatcggtcggaatgtagcacccgataagcgggtcatattccgtctggtaggtaatcagtcccagctctgcaaggaacgtcagggcccgggtggcccgggtgatggagagttttccggcagcagactccgtcgccagtccgcactcaatggccagcgtggtgatggaacactggacgcggttggccagtgggtcatagtgaaaacacagcccctgcagcagcgcatcaatggcccggcgacgtagtaccggtggcatgcgccgacgcagaccaagcgaacgggcatgtgccacatgaatggcgaaatcaaaacgggaggtgaagcccaccgccttttccatcagtttcccgcagaacggaagcgtccgggcaccttcacggggtgtgaacaccggattcgggttctttacctggcggtaataagtttgttgaagatcagtcacaccatcctgcacttacaatgcgcagaaggagcgagcacagaaagaagtcttgaacttttccgggcatataactatactccccgcatagcttgattgttggctatacggtttaagtgggccccggtaatctttctgactcgccaaagttaaagaagattatcggggtttttgcttttctggctcctgtacatccacatcagaaccagttccctgccaccttatggcgtggccagccataaaattccttaaacgatcagtaatctagcatgctacgccacaaagtaaagtctttactttagtatatccagtctctgcagttcatctttgatgattttctcaacgaactgagcctgtgttatcccctctctctcgcagtactcaaccatgagatctttcagaggatttttgacaaaaacttttatctctttgtgtgtaagacgttttcttgcaacagcggccatttgtttctcagagtcagtcataggcttacctctgcgcacaaaccgcttttgactcaatgaggaagtcactgcattttctgtctgcgacatctcgcctcctcaatactcaaacagggatcgtttcgcagaggatactacagttttttgaaatcagcgacttgagaattgtggcgaagatctgtgttggcgcacaaatcaacggggattactgtcgtttaatgtgatttaaactgtgaaatagtatggttttcagttatggaaacgccgggagcgaggaaaacttgctttttcccgtttccggggttggacaactgagcaacgcgaaggcgtcagctacgatgttccggtgactgctgatcagcccctgttgtattcagccattctccggtcatctgcagcagttttctggcatcgtggcttctgagcaacggaataccagcctgcctcagaacctcttccagaagaatatcccggcgtctgcgttccggtcgtaaatggctggcatcatccagctctactgctgcaacaatactgaacgaacgcagctcaacgataaccacatcaacatgccactgagacaccatcctgaataactgccaccactggcgtgatcgtggccggatattcccgttcagctggacgatatccgcgacccgtacctgcggacacagataccaccgcttcatatccacaattctgaacagtcctttcataaaactgacttccctttctgtcagcagcgtcttctgacgttgccagtattcaccgctggacagtattcgctctgcatcaccagtccgtatacctgccgcatgcaattgcatcagcaaaggagaatgctgatttacacttctgaggataatccggataagtagcgctgcaataatcagaacaatgagaataaaaataatcaacttcattatttatctgctcctggcaattaattattgctgaattattaccttacatatttccatatctcttttggtatcctgtcatataactttccggtgattaattccgctagccggtggtctgctgctgaattaaatgattcacgttcactgtttgataaactgtctctgtttttatgaataattttttccagcgtattgactgatgaacatcgccgtaactgatacagccattcctgttttgtttttgccatttttattcccgctgagaacagatgaatgataggattgccatcgctttatttacggtgcctccatatccaggggggaaccggatcagcatctgaccagagcccacgtttttgttgtctggcttcgttctgaaggacaggtagcacgggatctgtgttgtactgctcatatacccaggcagccccggcccggtccataaactgattaatattcattccgtctggtgcataaacctgcccgagaatacgaccataacgatctcgctgaaaatatgaggtagcctgagtttaacggacactccttcctgaaatagaatggcatcagaaggagctaataatgagcagaaaaacccgacgttactctaaagagttcaaagccgaagctgtcagaacggttcttgaaaatcaactttcgatcagtgaagacgcttcccgattattccttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacagaaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctgaggctacgctgtaagcagaaacgcaagttcagagcgactacgaacccgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaatggtagtgtccgctattgccagtacacctcaatatgtgacggtaaccgtttttcctgcgaccagtgatttcatcatgtctgttgaccaccggccataatcctgtttcttttccggtgcatcaatatttaccagcctgatccgcaccgccttcagtgagtccatgacctcgatggtatcaccgtccagtacacgaacaacccgtccatgaatatctgcagacaataccggctatgaaaagataaataataccagtggaatatatttcctcatgttattctccatatcagataaatgccacctgtatttcagaccccctgaatagtgcagcacacattgaataacaccttattttgtgaaattaatcacaaaatataaaaaatcgacttaatgcggaaaagactctgtgctactcagaactgtccggtcatactgaccgaccggatattaagaagcaaatctcataaactcctttcagccttctgactcctagagtaatgaaggctgcttttttcgttacacccttccccggcagcgccggtggcagtgttcagcccttttccgggcaaactgctgccagtctgtcctaggcgcaacacaggcagcccgtcgccatgcttctgccgcttccatccagcgtccactgacttccagaataacggcccgcccgccggcacgctggtaacgccagacctggccgttccgtgaactgtttctgaatccattcattttcttgtccccctttagttgtcagtattattgtgataaataattcagtggactggcttcctttcggaagcggaagttatttccttttaagccttatttccctgcctcctctctctgggggaggctttttttatttctcatcaagcacggcctgaagttctgcctttatccggttctggtgacgaattttcgccagacgcgctcccgcatacgcttcctcctcctgagaaatatgctccgtcacatacccttccgtgtcataccggcaggcaccggctttcatggcacacagatagctttctgaacgggtgatggccttcagcgccctgcgcagttttttatgcgagagcgggatattccgctgcgccacgtcttccagtaacacgtcccggataccgcaggccagaagccggggcgtgtcaccgtcaaataatcccggccaccagggcttcagggtattcacagcctcatccagcgtgggcaggttcagataaatggacagcgcctgtctggcctgcgctttttttgccgccagctctgcttcacgggccgctttctcggccagcttctgctttttcaccttccactttggtggcgtggtgacattgatgatggttttccggctgcggacaggcgctgttccctctgtcttccgcttcagtgtcagtaccggtcgcttctgctctgtcatgctgtgttctgcctctgacgaatcatcctcttgcggccaaagataccacacccgtcacagcgccagaacgcccagcacagccagatgacaggcatagaacgtcgggaaaaagtctccgggccagaaacggggtaatgattttccggcacacaacaccagaccaacggtcagcaccgtcatcacaagaccggccaccgccgctgcatcactggtggcaaggttaagcgccggaataacagccagcaggcaggcgaccagcgccagacgttccgctctgtcttccgcccggtacagccggttgctgactgccagcatcagcaacccggcaataccgtaactggtgccggacaaaggcccccacagggccatcaggagtatggccgctgctgtacgccacccactgcgcgtttcacaccacgtcagcacctgtgccgccactgcaaaggcaaacaggatattcccctcataccaaggaaagcctgccagataatatgcgaactgggcaataattccccatccccacagccggttaatggccggttgccggatatgcgcatgacgggacagattcagcccccacaccagggcaaaaagcggaaaggctcctcgcccggccagaaacatccattcctgcttcagctggaatatcagattgatgtggtccagtaccatcagcaccagtgccaccgttttgatgatatcccgctgtccgggtgaccagaccagaaatgactgcaaccaggtatcggtccgtgcagccagtgaatcgttacgtgtcgtgttcgtgttatccgttgtcatcagtgtttgtcttcctgtatcagtctccgcccggggttttctctttctgcaggtcacgaaccatatcccgctccatctgctgcagacgctcctgcagcaaattttcccgggcaacttcccggaccgcttcccgcacccgttgtggttcacgcagtacactctccggcagcgcggcttcccgttcagttatggcagcccggtcacgctcctgcccggcaatttccctgacagcctgctctgttttgccgtccggcaggtcaggtttgttctctgccattttacggacaatttcatctgcgcgacgttccgtttcacggcggatggcctcttcagcctgccgctgtgccagtacctctgccgtgaccggttcaccatttccggctcccggctggacgctgttgtccgggatatccccccacacgcggccaccggtgatggcaccgggattccacggacggccttcaccggcgattcttaccaccacaccactgtctggattatcacgggcaatccggacgccatcctgcatattatcagccagcaggctttctccgttacggctgccctgcagggccacgaactgcgcatccccgctgccttttacccgaccttcaccgctgaatccccgcagcccgtttccgtcatccgtggtcagcgggttcagccagataccggcggacttgccgttacggtcaaacgccggcagtgccacatacggttgcggatatttacgtcccggagcaataaaccgtgcaggactgtctcccccggccagccccgcctgacggagaacggcacggcctgccgccacgtcccgcagctcccgcgccgtactgaacagccgctctgcattcatgacctcccggtccggtttcggctcaaacacatcgtgggcagttcctttctgtacggcattgttgatggcatccgtccagccctgacggttatcggtgtacacctgcacatgctgcttcatacgcgacagggccacgtaggctgactcaaagccggccatcagtttccggttaccttccgtgccttcaagcgcgatggcaaaggtttcactcgccccctgtgcaccgtgggcggtgatggcataggccaggtcaatatgttgctctgcccgctcctgaccggggcgaatcacacgggtctgctgaccgtcagaaagtgtgacactgtcaccggaaaccgctgtcaccgtccagacgctgttggccacataaccgcgctcccggtcactcttcgtgaagcgtatcctgtcaccggtccccacccggatggtgtccggggtgtacagcgtgacgccttcagccaccgcctcccggggcgaaatcagccgcgtgttaccttccgcatcctgtagggttatcagcccgtcatccttgctgataccggcaatccggtgatacacattatccaccagggcaagggcatccgggttattctcccaggtggagagacgacgcagctccccgtcgcgtatattcgctgtgttcaggacaggcaccatgacctgcaccttccccagttctccggccttttcccgtgcatcatgaatcatgctgttcagtacgcgccggtcctcattcaggtgcgtgacaatcagcgtctgctcccgtgcttccggtgtcctgccggtatagtcgcggacaatggcttcatacagtgtcatggggacatccggaaaagcctcgcctttcagcatcgccttctgctgcgcttctgccagtttcgcttcctggctgtgactgaactccgtcacggagtgctccggtgcccatgcgccctccagacgtggcacctgagacggtttcacacgctcaagcccggacagcgccctttccacatcccggttaatcaggctgtataccgcctcccgcagttccggcgtctgacgcacaatctccttcatgatgaccacatcggcagcactgcgcgtctgctggagacggaaaggctgaccgggcgcgatggcctgcagctggtccgtgtcaccgctggccacagcccgaccgccaccggccgcaatcagggcgtatgcccgtgccatgtcggtattgcccaccatagagctctcatcgagaaggaacagcgtgttgctgaaatccggcgtttctccgctgcgctgctgcagctgcgtgtcatgcagaaaggacgccagtgtctgtgcatccacgccggcgctgcgcatctccccgaccgcacggtgtgtgggccccagccccacgacacggggacgttcactctccggcagcatgttcacggctgacatcaccgcccggaactgtgtggtcttacccacaccggcatagccctgcaccaccgtgaaacggtcagacgtttccagtatcatacgggtggcggcgcgctgtcctgatgtcagtttctccatgagttcgccaggtactctctccatcagcggcgtgaccgcctccttaccttcgagaatatggcgaagaatgctcttttctgcctcatacgacgcacgggaaaccagcaggcctgtgccatagccttttgccacatccacatacagtaaatcaccccgttttatctgcgcattgatttcccctcccaggtcagcaaaaccggttccttctgcagcaaacgacttcgcctctgtcagcaggtccaccatgctgaaggccaggtttttactttccagcacaggaagggccagatgaatggcctgctgtgccggcgtgtgaagcccagctttctgcagactgatagcggtttccagcaatgtctcaccggcacgcgcctttatctgctcagaaaccaccgtaaaggagggatggcgggcaagtttttccgcagtacgggtttcatccagtgaggaatacagccggacatcacgaccactgcgggccagaccattcagggtggcattgtccattgccatctgtgtgacggaggcaaaaaccgtcgcactgtcgctgacggaatgcccgggcgtttccacccagccgttctccagcttcagtgccgtgaacggtgaatcgctcacaggcagggtggccggttcagcccgtcccggcacaacaaccgtcatcgcatcttcactgacggatgccacctgcaggcggtcaccgccggagacgcggagtccgggaattttccctgtcaccctcagacgctcaccgtctgccaccggcattttttccggccggaacagcgaccagctgctgtccagggaagaaatacgcaccacctgcgtttcgccctgcgcattccgcagggtcaggctgtgactctgcgccgtcacacgttctgtcacatagcggtcatgactgcgtgtctccgggttccactgctccatcaccattcccgggcggtacatatcccgcagataacggctccggctgtccagccagaccggtgacagggcggtcatggttacctccgggtgtccgagcacgccctgtgttttcagctcactgcgaatggcctgtgtcagtatggcctgttcccgtactccgctgacctgtgccacgctctcttctccggctttcacgctggccgcaaaatctccggccagccgggcatagcggacattacggtccggttcactgatgatggtggccggtcgctgttctcccccctgccagcgatatgtgttcaccccggcatccttcatggccatcagtgcactgcctgtaccggttcgctgcccgctgtcggttatcaggacctgtacgttatgacgtgcggcaccatccagcagggttaacgtctctttcagggagagtttttcgccctggtcgacgataacggtactgcccggcgtgaaggccattccttccagcaactgacgacgtccggttatcagttcaccggacagccgttcatcctgcttcaggttcatctgcgagcgacggtcagcagcgataatctgcacctcccgcccctgctcccgggccatcatgaccagttcagccacccgctcacgctgcccggctgcaccgccctgcccggacacaatggccagcgacggacggtcctgtgccagaacactgacggcatcgctgtaaccggccgtccgggggacacttttctccggatgtacggtcacccggttctgtttcatgatgtcacgactgagtgcccggactgacagctcatcgagcatatgaatcccggacgtgaacagccccttctcacgatcgagggggataagctgctcacggctgatggcctcatcgataccggcgcgtgcccgttcaatcacaccattttccggcggcagtatgccgaccgtcctggccagcaggtccgtatacataaactgcactttgcgttcacttaatccggcaatggcctgtgtcaccgcctgctgcacatccggcccgtcctgtgaagcgggtccgggtgtctgcgtgcgggtatatgcccgttgttccgctgcgtcacgatatgcccggatgtcgaacccggtttccttcagcgtctgcatccactcggccattctgacttcaggatcgacgtgctgtttggatttacgcgtatccagcgccgccacatcccgggatttcagcgaggcgtcttccccgacggcctcccggatagtctgtgagcgtccggaaaaggcctccaccggtacacccggcatttcccacataccgtgcttaccgaccacttcagtttcatagcccagcgcctcaacctgctctttcagtttttcccggtagagcctgccaaaggcaatctgattagcgtacacattctcaatgaaccccgttttccccactttgtcactgctcagtgtcttccattcgccgttatactgcgtaacattagtcaccaccgcatgcgtgtgtaactgtggttcctgatcgcgactggtgtcgtggttaaacagtgccatcaccagattaccggtcagcaccgtttctgactgtccgtccgtcaggtggaggccagtgcctccacctgacggacagcaaaatccacggcctggttatgtgcttcaataagacgtttgtcccccccgagcatggccatcatggagatacttttgggagcggagaaggtcaggtcgtagccgggacgatgcctgttactgccatcctgcatgcggcttaaatccgccccgtccggcagcctgccctccagaaggcgggtaaagacatccttatcgacactgccctgcagccccagttgttcagccccctggccggcccagcgttctcccatgctgcccagcacatagtaattatccttgtcggtataataattaccggcacttccggccgatctgacctgcgcgatactcatcataaacgtatatccctttgacatatcccggtatcaatcccacaatagatatacacaagacatatccacataaggaggcaaataatggaaaccaccgtatttctcagcaaccgcagccaggcggtcagactgccaaaagcggttgcattgccggaaaacgtaaaacgcgttgaagtgattgctgtcggacgaaccagaatcattacgccagccggagagacatgggacgaatggttcgacggacacagcgtcagcaccgattttatggataacagggaacagcccggcatgcaggaaagggagtcattctgatgctgaagtttatgctcgataccaacatctgcatttttacgataaagaacaaacccgccagcgtcagggagcgttttaacctgaaccaggggaaaatgtgtatcagttcggtcaccctgatggagctgatatatggtgcagaaaaaagccagatgcctgaacgtaatctcgctgtgatcgagggatttgtttcccgcattgatgttctggattacgacgctgctgcagccacacacaccggccagataagagcagaacttgcccgtcagggacgccctgtcgggccatttgatcaaatgatcgcaggtcatgcccgcagtcgggggctgattattgtgactaataacacccgggaatttgaacgtgtgggcggcctgagaactgaagactggagctgacctgttcatcagaaatcatctcccggctcaacatcctccccgcgttcccggtgcacattgatgttcacctcttcacgacgctgcatctgctgccaggtgtccggatgattttcctgctgccatgcctcataagcggccatatccaccacttcaccggattcactgatctgaggtagcctgagtttaacggacactccttcctgaaatagaatggcatcagaaggagctaataatgagcagaaaaacccgacgttactctaaagagttcaaagccgaagctgtcagaacggttcttgaaaatcaactttcgatcagtgaagacgcttcccgattattccttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacagaaaacaaagtgatgagcggctaaaactggagattaaggtggcacatatccgcactcgcgaaacatatggaacccggcggctccagacggagctggcagagaatggcatcatcggtggtcgtgacgactggcacgtcttcgtaaggagctgaggctacgctgtaagcagaaacgcaagttcagagcgactacgaacccgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgccagtatacctcagctgcaccggggcgaccgtgtcagcgacgttgccagaacgctctgctgcgcccgctcctctgttggacgctggattaactggttcacgcagtcgggtgttgagggactgaaatcattacctgccgggcgtgcccgtcgctggccgtttgagcatatctgcacactgttacgtgagctggtaaaacattctcccggcgactttggctaccagcgttcacgctggagtacagaactgctggcaataaaaatcaatgagataaccggttgccagttaaatgccggaaccgttcgccgctggttgccgtctgcggggattgtgtggcgaagggctgcgccaactctgcgtatccgtgacccgcataaagatgaaaagatggcagcaatccataaagcactggacgaatgcagcgcagagcatccggtcttttatgaagatgaagtggatatccatcttcatcccaaaatcggtgcggactggcaactgcgcggacagcaaaaacgggtggtcacgccgggacagaatgaaaaatattatctggccggagcgctgcacagcgggacaggtaaagtcagctatgtgggcggcaacagcaaaagttcggcgctgttcatcagcctgctgaagcggcttaaagcgacataccgtcgtgcgaaaaccatcacgctgatcgtggacaactacattatccacaaaagccgggaaacacagagctggctgaaggagaacccgaagttcaggggcatttatcagccggtttactcgccatgggtgaatcatgttgaacggctatggcaggcacttcacgacacaataacgcgtaatcatcagtgccgctcaatgtggcaactgttgaaaaaagttcgccattttatggaaaccgtcagcccattccccggaggcaaacatgggctggcaaaagtgtagcggtattaagcgcagctatttaggcataaattaaatttaacgaactgcatctacacagtcctccgtgccaaacgggcaacacacggaagggggatgtgtttcgattggtaacctgtaagaaacaactagtggaaatacctgtactttataatttcaagggtacgggtccgcttcgtttgatttgcgcgtttttaacaattttaaaacccagatatactgttccggatgtgaccccaccaaaatttccactgttttgttcatttgtcgggcaatcattttattgtccgcgctggcaatgcatgcatccattggtggccgaacttcaatagtcaggaaatgttttttttcatcataaaccgggaaaagcggtataatcatagcctgactgatgttcatcagacgtccaataattggtaatgtcgctttataggtcgcaaaaaaatcagcaaattcactgtattcaggaccatgatcctgatctggaaggtaatacccccagtatccctggcgtactgactgaataaatggttttatcccatcctcccgggaatgtaagcgccccccgaatttacgccgtacagaattccagacataatcaatcactggatttcgttgctgatgaaacatggcggccattttttccccctgagctgccagcaacattgcaggaatatccacgctccagccatggggaaccagaaaaatcacatttctgttattgtgccgaatttcctcaagaatttcgaggcctttccagaacactcgtttctggaacttttccggaccacgaattgccagttctgccatcatcactatggattgcaatgctgtggcaaacatattgtcgacaattatttcccgttctgtatcactcttttccgggaaacaaagcgataaattaatcgtcgccctgcgacgagcttttctgctcaatctgcccacccaacgccctattttggccaagacaggatctctgaatgaagggggaaacattgaaatacctgcaatcattcccaaaacgaaccatgtaaaccagtaaacaggggaaagataatttttcttaaattcaggaataaactcggatttgtattttttcattatttagtgcgaatgcccctaccaaaatcatcattaatattttattcagagaatacatcaaaccttaatttaagtcctgatgttctgagtttacaggatatgcatccaaagagcggatagcagtttcatggatataatccagcaaagcgtatcgttttcgatactcagagcgttttttactagctatattgcttagcggctttcgaaccacctgtgttggtaatttgtaccagtcaccacaggttttccctgctacagactcccagaaatcactgtagacagcaacaaaggttttgcgtttctgataccagtatctcaattgccggaaaacatgactgtgctcactgactgccagacactcagagacattacaagctttcatcaacgcacaaaatgcttcaaaaataatccgttttgggaaaagcccataacaggcccgggttgcgcaccgaataacatcaggtccggtatttttgggggctccctgtaatccgccaataaaagcggtgtgtccattttgagtcagaatgactgaaaatgttaaccgggcaatcactattttattgaaaaacaatgacaacatcaactctccttcccggtcaaaaccactgggagaacactggatatcaaaatcctctccatctttcccgatgaattggactaatgataccgatttttgtggaaacaaaaattcagaatatttttctggcaaattttgcacaaagcgataatgctcaagaatatattgcccccgggaccaggctcgcccccctttatgcaaataaggtcgatgaattcttgctggcaacgtgggttgtattgccagaatatcctcaatgcactgcaaggaacgcagttcgtaataatatcgaatactggcaaccggatttatagcacatcgcaaaatgtacatgaaccggaattttctgtgttcccacttccccgggagtgaatctgaggaaaaaacaatccttttaaggaaaccgataaatgataagttacttacagaaaacatattgttacttgtgcttcgctaatgtgagtatttttaacgcagttttattaatatcaaaccgctcttctatatcctgttttgcctggcgagccatctgataaaaacgcccagggtcattaaaaaaatcattcagggcgcacatccatgcgtgcttattacctgctggtaacaatgtcccggtctggttattctgaataacatcagggattccaccaatctgactggccagtacaggcacagaaaatgccgatgcttctgccagtaccataccaaacgattcgttttctgaaggcagaaccaccagactggcaacccgatatacgggggcggcaggaaaaacattgtcagcaataaaaacatcatcatgcatgcccatactgtcaatctgatactgtaaatgctcccgcagttcaggcgaaccagaccccacaatcaaccaacagaactgtcgtccattcatttttaaatggaacagtaaattcaacataaattcgtgccctttttccgggcgcaacattcctacctgagcaataacggggcatccccttcgggacgccagccaagaaagaacatttggaggcaaactgtttcgggaatcaacgtataatttctggaaatcaaagcctggaggcacaacagtaacccgggttcgacatccttcctgctccagatgtgtcttcatacttgttccgggaacaatcacctcatcgcaaaaatgatttattgaaaaaacttttgtttttcgtgtcaaatatgtcttttgcctgataattctgaatggatgtttcctagtgaataaccgtactaaaccaacaatattgctatcatgcccactgtgacaaacgattgcattgggctgaaaaccatgaactattccgagtaatctccatgcagtagggatgtgaagactgtttcgaaataacgcgaatgtgatatcaatccccaatttactggcttcaaaagcaattttgctgttttccctgcagacaagcagaactgaatgccccattttcttcagggccttcatttgagcaacagcctgtaattcctgaccacctatattcggtgatgattccgtaaatagtatattcattattaatcatccggtaatcttggccccttatgaaaggccagcaacgatgaaaaaaacggtgttgtataataaaaaagtcgtcttttcagccatgcgcaactttcccgttctttggtgcttattcttcctatccgtgtagttcctttagcaggagcattcattcttctttctgttgtatataaataatagaatccaagttcttcagcgacctgaatataatccttgttataataaccttccggccaacacaaatgtttactgcattttcctgtcatttctttcaaatattctctcccgctcaacaagtcctgccgaagatgtttacactgttcttctcgtgaactgaactttttatcccagcgtgtatgagtatgcgtatgaacatgaaattcgaccagaccagattgcaacatttcgtttacttcagaccagcgaagcataacattatcagcattccctgtcgctatttgatgttcgcaatcgcgatgagaatattcctttccaggagagtgacgaaccggaccattcccaataaaaccggtaattaaaaaaatatgtgctttgagattaaactcttttaataaaggatatacctgaaaccagttgtcaaggtatccatcatcaaatgtcaacataacgcttttccgggggagttttccgccccgataaaaaaactccagttcatctgatgacagtgttttccagttgttttcagccaaccattttatttgcttccggaatgtcacgggagaaagtgtaaccagtccggggcaatgactgacatgatgatacattaataccggaacatgattggctttgaacaaaatgcccccttcgtttaacatttaaagtttctggcacctagtaagcagagacaaaaggaaaacccaataaagctggtgcattttatttccagatactggatgaataacatagcaaacccatggcatatttgatataatttactaaattaaacatcaacaattcataaacaatgatatattatcatatcttttaaaaacgactcactaagaaccttgaggtggcacactgaatttggctacctgaacagaggtgatatgttcacctcagaacaacacaggtgctccaatgaaaaaaaggaatttcagcgcagagtttatttacggggtgacgctttcattaacctgtacacgaacttctattccggcatcatgacaggcctgcagctactgcgccatttccagcggatcgccctcccggcgtaccaccccaccttctttattccataactgcagagcatttttctgattgttccatctgatttcggggggtattccgggcaaggttgttcagtaaggcattccttcgtaaaatcagcatgttttttgcacgacggaaaccggcagccatgaaaatctgtctttatcatactctgaatcctgacacgatcccgggttataaaaaatttgcacaggctattgccaccgataactttgttcaggctgatgttcgtaaaattgacaccaatctttaccgcgcccggctcagtatccgggaccgattactgttttcgctgtatcgctaccacggtgaaactatctgccttgttctggaatatattcgcaatcatgcctataacacttcacgttttcttcgcagaaacgtggtgattgatgaagggcgcttacaacaacaaccagtgccggatcctgttgatatcgcgactgaagcgctgacgtatatcaatccgtctcatgggcgtttccaccgcctggataaaatgctgtcctttgatgatgatcagcaggcactgtacgaacacccgctaccgctggtgattgttggctcggcgggaagtggtaagacggcgctggtactggaaaaaatgaagcaggctgctggtgatatactgtatctcagcctttcctcatttctggtggaaaaagcgcgtactctctatgacgcttcaggggaagggagtgaggtacagaatattgactttctttcgctgacggaatttctggaaactctgcgcattccggaaggcagggaggtgactttcagtgcgttcagcgactggctgccccgcaacagggctatcgccgcactgggggctgcccataccctgtatgaggagttcaggggcgtgatcggtgcggttgcctccgggaatgggccgctgtcccgggaggcgtatctgtcactggggatacggcagtcgctctatggcatggaggaccgcccgacggtctatgtcctgtttgaacgttatatcgcatggctgaaacagtcgcatcagtatgacagtaatctgctcagtcatcagtatctttcgttggcaactccccgttatgatgtcatttttgttgatgaagttcaggatatgacgcctgttcaactgcaactggtactgaaaacgctacgtcatcccggtcagtttttactctgtggtgatgccaatcagatagttcatccgagctttttctcatggagttcgctcaaaagtctctttttccggcagcaacagggaaacgacacaaccgttaatatcctgcaggcgaattaccgtaacgggcaccacgtcactgcactggctaaccggttgctgagactcaaacaggtccgctttagtgctattgatcgggaaagtcaccattttgtcagaagctgcggtcaggcagaagggaccatccggttgctggacgatagggaagagacaaagcaggaactgaatgccaaaacctcactttcgaatcgtgtagcggtcattgtgatgcatccggaacagaaagcacaggcgcgatgctggttcagtacgccgctggtcttttcggttcaggaggttaaggggctggaatacgaaacggtgatcctttacaatatagtaagcgctgcccggcaggcatttgatgatatttgcgagggtcttacaccggctgatcttgagggcgaggcccgttattcccgtccgcgggacaggcaggatcgttcagcggaaatctataaattttttaccaacgcgctgtatgttgcgctcacccgtgctacacacaatgtgtatcttgttgaacagcaggtggagcatcctctgtggagtctgcttgcgctcacgcatcaggaagagcctctgaatctgcaggaagagatttccagccgtgatgagtggcagaaaaccgcacatctgcttgaaaaacaggggaagcaggagcaggcggacaccatccgtagccggatcctgcagacatctgagatgccatggcagattatcaccgcagaggatgcacgacagtggaaacagcatatcctcgcaggtacagccgataaaaccatacaactgcaggcgctggagtacagtctgatttattccctgttcccgctgtataatgcactgtaccgggaagattttaagcccacaaggcagcccagaacgaagactctgcagttactggagctgaagtatttccggccatactcaatgaataacccggttgccgtgttgcgggatattgaacgttatggtgttgatcaccgttcgccgtttaatcttactccgctgatgtcagcagcccgggcaggtaatattgcactggttcagttactgctggagcgtggtgcagatcccttgctgaccggtaatgacgggctggcggcttatcatcaagttctgtcagcggcggtcagtacgccccgttatgcgcaacagaaaagtgcgcagttgtataccctgctgaaacctgaaagtctgtcactgcaggtggaaggacgcctcatcaaactggacaaccggcagatggcaatgtttctggtgatcctgatgcaggcgctgttccacacgcatctgggaagtgctctgtttttttcggaagccttcagtgcggcacgactggcagagtgtgtggttcatcttcctgaagcgttgctgccggaacgccgcaaacgaaggagttatatcagcagccagctctctcaacatgaagttaacagcaaaaatccttatggaaaaaagctttttctgaggctgaaccacggacagtatattcttaacccggggcttaaaataaggcagggtgatgtgtggcgcgcggtttatgagttgcagtcaccggaagatctggggcatgatttgcagacttatctgcaggatatgtcaccggaattagtggatatgctgggagggaagaagggtttttacgaacgcagtgaaaagtctgtcggatactgggtgggggggatccgtcgtgccgctcaaaaagcgtgaggttccgtgctgacaggatgtaaccgaacttcatctgtacgtaagtacgtgatgtctcccgcccacttctggttcggaccactggcgtaaaaatcctgctccagcagattttctgacacgggcaggccatgtgcgcggtaactgaccgggctgaacttccgggaggcctttgccctcagcccctgacggcgcaggcttgccgccacggtttttacgttaaagtggtaaccctgagcacgcagttcatccgtcaggcgtggtgcaccgcaacgctgttttgaccgggtaaagaacgctgtcgcagtgctgacggaactgctgacgagggcttatccctgtccgccgctgacaccacgttcaacagtttgtggactgttcgctcgcttccggaaatcagggctttcatggcctttgcctgcaggtatgtcggagcaggagcttgatgcccttctttacggaagtgcctccacagtacctgtcgtacttactgaaagcaccgttatgcccaaactcccggtggtaaaaaaaacgtccccggcggccttaatgccagtcagttaagcaactgactggctctttttcggggctgtggggtatttccagggcctctcctttaccactctcgggaaggccctttgaaccgccccgggtttcctggagagtgttttatctgtgaactcaggctgccagatcatcgtttccgatggaagcataataagctttttctgcttctgccggagggatgtggcccagcctttccagcaatcgtcgattgttataccagtccacccacgttagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgcatccggcaaacacatcaatgatgaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgggcactgcgtttatccggatgatgtcgctgttgctgacagtggtaatacgttgacggggcaatatgcagttcactgcataccggtccgaccccgtactgctcacgcagcttatccagcagtggcattattttttccagaggcggtcgaactccgcctttgcaaaataagcggaagccaggcgaaggatattgttactgcggcgcagttcacgattttcacgttccggctctttcagacgctgacgttcagcggtggtgagccctccatcaccgcccccggtatcccgctcatgctggcgaccccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcacttccccttctcgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctcagttgcatcgtctgttttatctccctgtatcccagttcgatttcccagcgattactgtacagatccgccatttctcctccggggaagcgcatggcgtccgtcatcgacgtcagcagatggcagacttttcctttgcgcgtcacggtcagcaggcgggctgtcacttcatttcccagtcccggccacttttttcgtgcctgcgggctggttttcagcttcaccagatgatcgcctttacccagttttctgagctcttcatattgcgctcccttcctgagaggtatcatccagtggcggtgttctcccgccaggctccagccatttaacagtcccagtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggataccagatcaagagcctgtccaatgtgcataaaaaaatccggaaacaagtgagcgtttccggattcttacacagccactggatcggtcaactgatccttaactgatcggcattaggccgccggggacgtttttttaccaccgggagtttgggcataacggtgctttcagtaagtacgacaggtactgtggaggcacttccgtaaagaagggcatcaagttcctgctccgacatacctgcgggcagaggccatgaaaggccagcgttgcggaagcgcacgaacataccacagacagttgattttggtacgcccaggcgacatccggccacaacccgtggtaaatgttcttcgaaatgaaggcgtaaagcttcagtgattcaggtccggtattccatacgatagtgggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcacatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattacccgatagtgtccacttcaaaatgatggacattatttttgtggaaccggaggtaacagaccagacggtttaaatgagccggttacgtttcaggtgtctctggctggaaatccgtgcgtgattcgccttgctgcacaggtatgcatgtggttaaaatttatcatacgcgatcgcggcggtttttcgggtggtttgttgctatttttacctgtctgctgccgtgatcgcactgaacgcattctggcggtgcatacaattaagatattacgttaatatcgcgagggaatggtccccatattctcatagaagagcctctggcttatagcatcaacaaatacgtctataaatatttcctgtttaataacgaataaaaatcatttgtacgcatttgtaatcgtcggtcgataatctctttatcttttttggttgcagcgtaatattcagcataaatattgcgaaaatctattgggaataaactttcactttctttatcatacagcatattacctgtattaagatcgtaatggattatactcaactcattcaatttacatatcaactgtagataaaggctctctatattatcagggatatcagctgtatcaatgtcactaaggggagtcccaggcacgcgcagcattcggaggtacacatctccgccatactgtataacaacggatgcttcatcgccataaaaagcattaaaaagctcagattcttgccaagccatttccagaatctcattgtactggttgccaataagatcatactttttatacaaagcagatgaatcattcacatcttcaaagatttctgctgtcgacccctgacctattaacttaccgagaatgggctccgttactatgccagcatgagaattattattctcaaatggaaaaggtgtttgaataatggtagatgttattttcatgtcatacctttgttacgatatttaaaaatcacaagagattttcacacaaaataacgttacacgctaccttgtgtggtccagatgttccttccacacgaccgttgcggcctttatacggctgccctgccaggctgctggctgaataaccaatccgttcgtccggttcaatggcggccatcaggttctgctccgcaatgtactacgaatgcgcttcctgtcctggatggccagcatggtccagaacatctccatcatttatcagcaatcttcctgctcatttcatcccgccatgcagcagcagaggattcgaccatgtcatggggaagcacatcaccgcattcgagttgctgacggcctgccgcaacctggtcacggaaccaagaattgtgctgccgttcaacggtctggcgcataaaatcccggattaactgagagccattacggtccatgctttttgcagcggccataaaagcatccttcagttctgcgtcgattcttacactcatattaacctgtgccatttgccacctcgtcattaccacgtatatacacagtatataactgttcagatatcgtcaccaggatatgccgcgccagcggcatgtaaggcggcactccgttgttgcatatggcagaggagtaaaaccgccgaagcccggcgtaagccggtacgtattgacaggtttcacctgtcctatcactggcgctgacagttttatgcgatgtgattatgaatggtgcagttgtgagccgttttcagacaatcgcagggccagtacctcgtcagtcagctgacggtaaatctgctgttcagtctcacgcatcacctgtgcaccggcttccctctccgcatccgcatcaccgctcagacctgatgctttcagccggtcagccaccctctgagggtactcattctccagcatctcatatttctgctcttctgcctgcgcccagcggtcagcttccgtacgcttcagtacagcatgccatggtccccagagggagaaccagtccgtaaattcattctcttcacggcttctgaccatggcttcggcagtgcggaggtcatttgctgtcactcccgacacgccatagaaacgcatttccttcacggcagtggagagctgaagtttctctgcgagcatggtctggaaggccaggtagacttctatctcatccacaaaatggagagttctgactttatcccgggcaatatcctccagaatttcgaggcggaacatttccctgcccagggagagcagagcgccggtatcattatcgaaaaggccttctgatgcctgatggaccaggagggttttccggagattgttccatgtgagcgcgacacggtcctcacagctctcagtggcatcagcagcaacagcgaaagactgctgtcgaagctccgcagaggcactgagtttttccagccatgcagcgacctgttcacggaatccggaggtattgcgtgcagagacggtatcggaaaggcggtcaaggaacgcggaaaaggtgttggcatgctcttcatgttcaaaagcatgccatatctgtgatacatcagattgtttgttttccgggaaccatgctgtcacggcatcagccagggggcgatggagtgtattctgttgtccgtcactcatggagaagtaaatccgtgggccgtggtagtccggcgaagaggttaatctttgcagggcttgcagagcatgggatgataatgggttatcactaatatgtattgaacattcattcctcagattaagaatgctttccgggatatgacttatctgatttctatcaaaaaaatactctctgacaacgggattatttccctcagaaaatgctggtagctcagtgaggaaattacgggtcgctctgagatttttaagagcctgtgggagcgatggtaaggagactatttcgttatagctgatattcatagtcaataacgaatcgggtaaagctggcaggttttccagctcattgtgttgtacctgaagtgactccagcgcaggaggtagcacgggcaattctgataatttattgctggcggaatataatttttttagcgtaacaggcagttcaggtaggttagttaattgattatatgatacattgagcagcgttatctgagctggtaagttgtcaggtagcgaggacagatttaaacggtccagtcgaagttcatcggaattattgataagacattctttaagtcgggagacagcctcatcacgctcttcaccggggagcgcttgtttttcccatttatcccatgctgaaaagtaatcagcatatgtaccggaaatagtgttataaaaagaattttggggcaatgaaaagttattatttatcggtaacatgatgggcatccagttaaagccggtggacaaatggctttgttaaaagaaataagtaggagtttttatgaagttcattccatgaaatgaacttcagcacttttttattataataaggataaacaaaattggctgtaaaaaaacgatactgtttcagttaaccgtgaatggcctgtttgcaccgtattgttcttgtttttcggttagttaaacatcgtacttcatatttgaacggtaagcggctcgtcagaaccgtattgatatttactgagaggtcagatcaactttccaaggcaacagatcgcgtacccggtttgccggccagtcctggatatgctcaatgacgtaacgcagccattttgtcaacgccacgatttttgaccctagcctgacatttatattccccagaacatcaggttaatggcgtttttgatgtcattttcgcggtggctgagatcagccacttcttccccgataacgaagatcggcacactggccatatcagtggtcatcatgcgccagctttcatccccgacatgcaccaccgggtaaagctcacgggagactttatctgacagcaggcgggcactggccagggggatcaccatccgtcgtccgggcgtgtcaataatgtcactctgtacatccacaaacagacgataacgactctctcttttataggcgtaaaccttaaactgcatttcaccagtccctgttctcatcggcaaaagagccgttcatttcaataaaacgggcgatctcagccatcccctgctgattttcagcctgccagcgttccgcacgcagacggcgggcctctttttgcatggccgtatttaccaggcctgagatattcacgtttgcggatttaagtaactgatagctgtcactgtctatagtgacagtaatacgctgcttcatgataagccctcaaaaacatacttatgatatgtatatgagtatatattaatggtacaaaccatcaatatccataaaaagtacaccattaattcgctataagtttttaatacaattttttctgctgcgatttttttatactataattagcatacttataacaccgtaagtaaattacatgaaagcaggcacagcgtgatccgatttttctgcgtataacgattttccggaagtgtaatacggttgcgccccgggccgggcacccttttctgttgttgtgtacgggcccacagagaatggtaccggaggcgggctcagaagtactgagtcgggtgatcgcgtcaggccgcgaagtactgacacgggtattggtgactggtgatgaagtactgccccgggtatgatttcaggctgattcaggttctgattctctgtcagtccgcgtggttgctggcctggctgatttcctgttgtcaggcgttcaacaaccgactgcaggttatagcccggttcacgaacacctgacggcaggtatcactcacccggtgaaggtaaatccctcaagaggcagcaactctgccagtcgctcctccggccattccggcagacgcgtcaggacgtccgtcagccaggcatgtggctccagaccattacgttttgctgtttccagaaggctcattatctgtgccgcccggtttccggccatcagtgaaccggcgaacagccacgctttccgtcccataacaaccgggcgaatggcacgctcgcagatattgttgtccaggggcaccgctccgtcacccaggaagcagctcagttcatcgcgccggttcagaatatagttaatcgccttatttaatggcccgtcgggcggacagcacggctcctgctcttcaagccaggcaaacaggtcattcactatcggccgggagtaccgttatcgccactgccgtattttttccacagggcgctcacggatgagtttctcaatgcggtaaagacccgcgatttttctcagctccacgcctgcacggggctccctgctggccttatacagatttgcgaagccgcgccctgcgtgactccagcaacaggctgatgtgatgccggggtgattatccgccagagatttgtacacgctgtatccgtcactcaccagcgtactgccacaccagcactgcagccaggtctcagggtatctgagggcccgtccggtctgcgagtcaaaacagacgaccggcggaccgcttctttcaccgctgacgtaagcacacagccagccggagcaggatttaccgcctttccgggtatcaaggagcctcagggacgtttcatctgcatgaataacatcccgtgtcagaagctcatggcgtagcagtttcgccagcggggccagtgcagctccggcaacaccgaccatatccgccattgtactgacggggagctccacacccattcgggagaaaatgtgctgctggcgatacaaggggcagggtaatgctgccaacttactgatttagtgtatgatggtgattttaaggtgcttgcgtgacttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagcgcacgcattatgggcgttggcctcaacacggttttacgtcacttaaaaaactcaggccgcagtcggtaacctcgcgcatacaaccgggcagtgatgtgattgtctgcgctgaaatggacgaacattggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatggatgacggatggctgtccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattaccctgttcattgtccgcgctgtcattccgatgaagtttatcgacatggccgtagttgttcccggcatgagcgtttccgttgtcgctcatgtaaacgtgttttccagctcacttactcttatgaagccagaaaacccggcgttaaggagcagatcgttgaaatggcacataacggcgcagggggccgtgataccgccaggacactgaaaatcggcatcaataccgtcatacggacattaaaaagctcccgccccggcggataacatctgcgccagtcgctcacgctgatgttgcccttatctgtgaacttgatgagcagtggcgcttcgttggcagcaaggctgcaacaacactggctctggtatgcgtacaacactaaaactggcggtgtgttggcttacactttcgggccacggaatgatgagacctgtcgggaactgttagccctgtttactccgttctgtatatattaggccgttggtggtaagtggatcactttttagacacgaatagctgcagttcacaaaaacaggaatccggctccgttttttgttgtcatatcagagggatatttgttatgaagaaaatatagtgagtatatatactgtcaggatacaatatgattaatggggtgtcgttacagggaactgctggatatgaggcacatacagaggagggaaatgtaaatgttaaaaaattgctggaatctttaaactctaaaagtcttagtgatatggataaagattctgaattggcagcgactttacagaaaatgataaatccgtctggtggggatggtaactgttcagggtgtgcgcttcatgcttgtatggctatgttagggtatggagtaagagaggctcccgtacctaatgaaatatcagagtatatgaccggattttttcataggcatttagagcaaattgatagtgaaggcatagtgtcacatcctaatgaaacttatagtaaatttcgtgagcgtattgcagaaaatattttacaaaatacttcaaaaggaagtgtagtaatgatttctattgaacaggccactcattggatagctggatttaacgatggtgaaaaaattatgtttttggatgttcaaacaggaaagggatttaatctttatgatcctgtagaaaaatcgccagatgcatttgtagatgaaaatagttcggttcaggtaattcatgtatctgatcaggaatttgatcactatgctaacagtagtagttggaaaagtaagaggctttgctgatgctgagagcctgtacatagatttgagccggccccttgaaacgccagacagtggatgtatcttaaaataagagataggcttggatatatgtctaacactagttctaattttgagatgactggaactttgctggggctggagcttcgtaaacgtaaaactcctcaggaaaaaattgccattattcagcagacaatggagcctggcatgacggtgtcccatgtggcgcgtttgcatggtattcagcccagcctgttgcttaagtggaaaaaataatatctggaaggaagtctcactgctgttgctgccggagaggatgtcgttcctgcctcatagactggccccctgaatctccagacaaccagtatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaagaaggaagtcttactgctgtggccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgcccacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtgactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcgtagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccacctcagaactgatagtcttaatactagtttttagactagtcattggagaacagattattgatgtcttagagccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtggccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgcccacgtatggttatcgtcgggtatgggcgctgcttcgcagacaggcagaacttgatggtatgcctgcgatcaatgccaaacgtgtttaccggctcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtgactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacggtaagcgccccatcagcgacgtcttgtgaaaattgtcctgtctggcaacaatcgcgcccatctatattgatggacacgaacgatgaattcccagacaacaaaagatattccctgcttccgttcttatttgcctgatgccctgcgtttaagatttgaagataaactgaccatccgggccatcgctcagcgtctgggtctcagtcattccacaatacatacgctttttcagcgatttcttgcatccggtatcgcatggccattgcccgattcagtttcattcgctcaacttgacgccatcctttatgccaacagaaagaaggaattaacagagcctcaaatcagagaaggctcatggcgaaaagaacggcgaaccagctatagccgtgaatttaaggtccgtctggctaagcaggcattacagcctggggctgttgttgcccggatcgccagagaacacgatatcaatgataacctgctgtttaaatggaaaagccagtacgaggacggcttactgagcgatgatgacatacaggaatgcatgcctgtcccggtggcactgactgatacgccggagccgaccagaccagttacaaatcccttctggcgtaacaagcatgatgagcgccctgagggggctcccggaaacgtcccacggtgcgagctgcatcttaaatcaggtgtggtaaaactgtttgaccctctcactccggaactgttacgggcgctaatccgcgaaatgaaagggggtatccgatgataacgctgccgaccggtaccaaaatctggatcatcgctggcatcacagatatgcgttgtggcttcaatggcctggcttcgaaggtgcagaacacgctgaaagatgacccgttctccgggcatatcttcgtcttccggggccgcagtggcaaaatggtgaaaatactgtgggccgatcgtgacgggttatgcctgttcaccaaacgtctggccggtgacccgggaagggaaagtgcacctgacgccagctcagttatccatgctactggaggggatcgcgtggcaacatcccaaacggacagaacggcctggcatccggatataacccgtgataaaacaagggaatgaacaatgaactccccgatgatattgagctgcttaaagccatgttgcgtaagcaacagagtcggcttcgacagtatgcctgtcaggtcgcgggctatgagcaggaaattgaacggctgaaagcgcaactcgacaggttgcgtcgtatgttgttcggccagagttcagagaaaaagcgtcataagcttgaaaatcagatccgacaggcagaaaaacgactgtcggaactggaaaaccggctgaacacagccagaaatcttctggaagatgcatcgtcagtcacagattcacctgacaccagtcccccgtcagaaaacccgatcgccagtaagcctgaatccccgggacgaaaatcttcacgaaaaccgctgccggcagaacttccccgggagacacatcgccttctgcctgctgaaaccagttgcccggcctgtggaggtgttctgaaagaaatgggggaaacaatctcagagcaactggatatcattaataccgcctttaaagttatcgaaaccatacgtcccaaactggcctgtagccggtgtgatgtcatcggcaccacttcctcctaaaccgatcgaacgcggttatgccagtgcagggttacttgcacggatcctggtcagcaaatatatggaacatatccctttatatcgccagtcagaaatatacgcgcgacagggcgtggagctgagccgtaataccatggtgcgctgggtatcagaaatggcagacaaactccgtcctctgtatatagcgctgaatgactatgttctggaggcaggaaaggtgcacgcagatgacactccggtgaaagtactggccccggggaacggaaagacgaaaacgggtcgtctgtgggtatacgtcagggatgatcgtaatgcgggttcatccctgccggcagccgtctggttcgcgtattcggcagatcgcaaaggagaacatccgcagctccacctggcaaagtatcagggcgtactgcaggctgatgcctatgcaggttataacgtactgtacgaaacgggccgggtgaaggaagccgggtgcctggcccacgcccgccgaaaaatccatgacgaggatgtgcgccgtccgacagaaatgactcaggaagcgctcagacggatagcagagttatacgacatagaagcggagatacgtggcagtccggcagaggaacggcttgcagtcagaaaagccagaagcgtccagttgatgcagtcgttgtacgactggatacagttgcagaggaaaacgctgtcgaaacatgcggagatggcgaaggcgttcgactatatcctgaatcactggaatgcgctgaacgagttctgtcgtgacggctgggtggaaatagacaacaacatcggtgaaaacgcgttacgatcggtggcggttggaagaaaaaattatctctttttcggctcagacaagggaggagaaagtgcggcgatcatctacagtctgctggtcacctgcaaacagaacgaagtggagccggaggactggttgcgcgaagtgatcgagaagctcaatgactggccgtcgaaccaagtgcatgaactgctgccctggaacttctcgtctgtaaaataatccttacgctacgtacttctcggggcgcttaccttcaaaatgatggacattatttttgtggaaccggaggtaacagaccagacggtttaaatgagccggttactttaaacgggtgatggacagcacctcaaaagttcagatggattatatttgtctgcaataccccgggtattttcgatttgcgaaatggatggaacgacttgctcaggggatagctgatggagttactgaagtaccgaaggaccactaaaaatcacaggccgggaatttcggcgtttccggcgtaggtgtgccacgaatgcatccagtggcgtgatgttggatgcaatgctgtatgagagatgaggggcggcgtccagacgcagccttcaaaccgccttgagctgctgccgttaagagcggtggtggtgagcgtcaaggttaaaaggcgcagaacatgtgtcaggtaggtgttgcggagatgaacgaaagtgaactgtcgatgaagtgtcgaaaggaacctctaggcgatgtcgaaaatgtgctatctacgcagcgcatgacgagtccagcagatatctggtactggctgggcggcatccggcatataggcagcatgaacgcaacacaggctctcgcacggaacgtgggaacctgtcgtctcgatgctaagggagcggcgcggagcagaggcactgcaagcgcctgagtaccgatgcgagacacaggggcagatggcttcgtagtagtgaggaagtgcctgtaatgggcatggagcgaagggggtcagtcgttggggctggtttatcggtcaaccggatagccgggaggagcccatgagtcagccaaagccgttcgaggtctctaagtatgcggtttggaaagcataccagcgggtcaaagctaatcgaggtgcggcaggtgtcgatgggcagtcagtcgaggcgtttgaggttaccaatcgaagctatacccggtaatggcgcaggttgacctgcacttggccaagtggattgcccgcaaacacaagcgagcgcgaggtagtctggtgcgtgcattcgagtggttactgcgaattcgtcacgactgcccgacgctgtttgcacactggtgcttagcttacgatacttgaatggttcaacgacaagagccgtatgacgcgagagtgtcacgtacggttccgtgggagcgtaggggggcggtgcccctgcgccacccgatatcccctttgagtgcggttacgtccacagaggtaaatgccgctgacgcggcatctgtaatctgttactttgtgtatatcatttgctatatattgtcaatatgctattgttgtaaagcaaatgatatacggaggctttatgaaatcaggtgttcagctcaatctcagagcaagagaatcacagcggatactcattgatgctgctgcagaaattcttcataagtcgcgtacagatttcattctggaaatggcctgtaaagctgctgaagatgttattctcgaccggcgggtgtttaattttaatgacaggcaatatgaagagttcattgaaatgcttgatgctccggttgcagatgatcctgccatcgaaaaattgctggcaaggaaacctcaatgggatgtgtaactgcaccagaacctttatcctcatttcatcaggtcgctgaatttgtcagcggtgaagctgtacttgatgactggttaaagcagaaggagctaaaaaatcaggcaatcggagccacccggacttttgttgtatgcagaaaaggtacgcaacaaatagtcggtttttactcactggccactggtagtgtcaatcatacagaagctacaggtaaccttcggcgcaatatgccagaccccattcctgtaattatacttgcacgcctggctgtagatgtgtcatttcgaggaaaagggcttggcgcggatttacttcatgatgcagttcgtcgttgttacagggttgccgaaaatatcggtgtgcgtgcaattatggttcatgcgcttacggaaaacgcaaaacagttttatattcatcatggttttaagccatcaaaaactcaggtgcaaacattgtttcttaaactccctcaatagggagtaatgccgatcagttaaggatcagttgaccgatccagtggctgtgtaagaatccggaaacgctcactcgtttccggatttttctgtgcacagtaaaagaccacctcctgaggaggtggcttttcagaatgccccctataagggctgagggatccccacaaaattactgctaataaaccagcaccatatttcggtaggttctggacagatggtttagaactgtgctcagtactgttcgtcttaaaataagtggcgagtgtcgaagaacattcttcgctaacgtcagatatgagataacccgccgggatttaatgctgttagcctgatatttcaggtgtaaccctttattttcagcgtgataaccgagtaaccacattacgatagtgctcaacgttgccagcagactcagaaccagaattcttcctgttgaacgacttttgctggcccgaagactgaggtagcctgagtttaacggacactccttcctgaaatagaatggcatcagaaggagctaataatgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacagaaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctgaggctacgctgtaagcagaaacgcaagttcagagcgactacgaacccgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgttactctcgtctggggaatatcaccccggcagccttcagggaaaaatatcatcagatggctgcttaaaaaaagaacaaatggtagtgtcctagactggccccctgaatctccagacaaccagtatcacttatttaagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtggccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgcccacgtatggttatcgtcgggtatgggcgctgcttcgcagacaggcagaacttgatggtatgcctgcgatcaatgccaaacgtgtttaccggctcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtgactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcgtagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccatgtccgctattgccagtacacctcacccgtcctggcgacgtatctgtaagacactcataaagaatgatttctggtgccggactctctccttcagtccgaacaaaccccggcactatgaacgttacctgcagcgtatgaaggaaaggaggaaggaatgggggactctgtgacaccggagatacttggcaacatgattcgtcagtatttcagtcaggtacgaactgaaaaagagagcatacaggctctgaatcatctgcgcagagtgcttcatgaggtcagtccttttgcacaggagcctgtggactgtgtgttgtgggtgaaagcggatgaggtggtggccaacgattacaaccctaatgtcatggcactaggtgagaaaaaactactgaaacagtctctggagaaagatggtttcacacaaccggtggtggtgtcagaggagaagaatcattatctggtggtggatggttttcatcgtcagttactggggcgggaagcagatacaggaaaacgcctgaggggctggttgcctgtagcctgtattaatccggagagaaagggacaggccgcacgtattgccgcgaccattcgacataaccgggccagggggaaacaccagatcactttaatgtctgatattgtcagggatctttcacgtctgggctggacgaatgaacgtattggtacagagctgggaatggaccaggatgaagtgctgaggctgaaacagattagcgggctgacagagttgtttcaggaagaggatttcagctcggcttggacggttcgttgatgttgttaaatatgggcggtatttctgaaagttgatactttgggtagaaaaaatgataccgaaaactatggaggatgtgcttgtcaggtgactggacaccataggtcttaggctttgataacgggataagatgagcggcttttctcataccatcaggtgtgatgatggcgcagatttacaaaatctgattgattctaaagatgtataagtaaaaatcaagctttgatatgaaaaaacagatatttattaataataaacctcctgtagtcccttactcagggacgcacgcgaaaatatttaaatacattgaaatccctctgccgtttttctactttatctatacatcaggcgaaccattccacatatctgtccaaaatactgttatttatgtatcaaaatacaatggtatatttattaataaattagttcctttttctcttttatttgacagggatatatctgttcttcaaagaagagatatttgtgttgtgcgatttacgtcagaggaaataagtgaacataacgttttatttgatcatgacattgaacgattaaaaaaaatttccaaagctcagcttatatctcccgattatgttttgattgatttttctagtgtggggggggggggagatgaaccctatgcaatgtcctggttaatatctcagtgtgctcatcagtgcactgataataaaaagacggagacagatgccatttacgataaagttcggagttcttatttgctttcatgtattctgaaaaaaaacaaaaatgttgggcttattcttcatgcaccatcatttgtttctgtgtctgaaaaaatcgccagaattgtgatggcaaattactcccgtaactggagtaattccgagttggccagtgcggttttaatgagtgaatcttctttaaaaagaagaatgtacaaagaggtcggttctataagtacatttgtacataaaataaagcttacagaagctatcaggaaattacgaaggacaaatactcccatttctgtcatatcatctgagttaggttacagttcaccatcgtatttttctaaagtcttctttaaatatttaaagacataccctcaaaacataaggaagaaaaatggtcggtaatgtcaccaattaggaggacttgcagagccgcttttttacgatactgagatcaaacagacataatctatgcggagatttacagcagggcatggttcacaaatctgacagcgatgaattatcggcactgcgggcagaaaatgctcgaatcatcaagcccctgttacctcctgaacccgccacaccacgggccggacgcccatgggctgagcaccgtaaaatcatcaatggcatgttctgggtgttatgttccggtgcaccatggcgcgatttacccgaacgatatggggcatggaaaactgtttataaccgctttaaccgatggtcaaagtcaggcgtgattaatattattttcaacaggttgctttcgctacttgatgcaaacggctttattgactggtctgccaccgcgctggatggcagtaatatccgggcgctgaaatgtgccgccggtgctcaaaaaaacatcccgatatcgacggagataatgggccgggtcgctctcgcggcggttttggcaccaaaatccatctggcaacagacggaagtggcctcccgttaaatatcgtgctaagccccggacaagctcatgaaagccagttcgcgcaacgacttctggacgggattggcgttcagcgtcagaacggcagcatgaaacgccgtggacatgcggtactggctgataaagcgtattcagggcgcgcattgcgcaacgagctgaaaaataacggtataaaggcagtaatcccccgaaagtcaaatgagaaaatggcatcggatggacgtgcacagcttgatcgtgatgcgtactgcaaccgtaatgtcgttgaacggtgctttgggcggctgaaagaatatcgccgcatcgccacgcgttacgacaaaacggcgagaaattacctggcgatggtgaaactgggctgcatccgactcttttatcaacgcttacgtaattaagggacacagcctagtctccaggattcccggggcggttcaatcaaagcgcagaacttctgcgtcttcttcgtcaaaaaaatcatcttcgtgaagcttcacgacatagcggggaagtttgcttctttgagaggcgggtttacgtttacgggatttagctgaacgggccatataaccacctgaaagacaatgacattgcctgtttttataacggtaattgcagaccatgacaaaccgcagccgtcaggctgcctactcgagtcacaaggctctttgtgtccgatatgccggcagcgcattacccatgaaactggctggaacgtacaccataaggtgaagaaagttatgggggcggtgaagaattatctaaccttgtcttgttacatccaaattgccatcgacagttacacagttgtgaagccggctctctcaaaaagggcttataaaggcttgagcggtgtaccgggaaaccggtatgcaccgttcttaggggagggcagtccagcaatgaactgtccttacccgacaaacatccaaaacgaacggaacgtgctggaatccgcatataacccgttgtaaagtgaggaaatggacacctcacttgctcatgagaacgcccgcctgcgggcactgttgcagacgcaacaggacactatccaccagatggctgaatacaaccgcctgctctcacagcggatggcggcttatgcttccgaaatcaaccgactgaaggcgctggttgcgaaactgcagcgtatgcagttcggtaaaagctcagaaaaacttcgcgcaaaaaccgaacggcagattccattttcacgggcgatctacgccacacaggctctgggttgcagtgactgctccattaaggcgattttgaactcataagggaagtaacaaaaaaactgcaaaagtacaataattatatatggccaaactaacctctattaaaaaacatcagtttttcacacttagttgagcttcatgaaaaaatcatcgaggatttcattgcagaatacacattccactaactggaagcactccataagaggaatcagagaaagtatcgtttttttatagtaaaattcattgctgttcaataaaattgatatagttattaaattatgaaaataatttcacaaaaaagattaacttgagttcttaagcatcggattttagatattttgaaatatctggcatcacataacatcaaaagtatataatacccttatctaattacatgcagtatattgtatatatactcaaaaattgtaattcataccctgctatatcttgtagggaaagatattaattaaaactgttttcatataaggttcattttatgaatatatcagaaacactgaactcagcaaatacccaatgcaatatagattctatggataacagattacatacattgtttccaaaagtgacatcagtgcgaaacgctgcacaacaaactatgccagatgaaaaaaatttaaaagatagtgcaaatattattaaagatttctttaggaaaactatagcagcacagagttatagtagaatgttctctcaaggctctaactttaaatctttaaatatagcaattgatgcaccatcagacgctaaagcctcatttaaggctattgagcaccttgacagattatcgaagcattatatatctgaaataagggaaaaacttcatcctctttctgcagaggaactcaatttgctttcgctaattattaattctgatttaatcttcagacatcaaagtaattctgatttgtctgataaaattttaaacattaagtcattcaataaaattcagtctgaaggaatatgcacaaaacgaaacacatacgctgatgatataaaaaaaatagctaatcatgactttgtgttttttggcgttgaaatctctaaccatcagaaaaaacaccccctgaatacaaaacatcacactgttgattttggtgcaaatgcgtatatcattgatcatgactctccatatggatatatgacattaaccgatcactttgataatgctattccacctgttttttaccatgagcaccaatcatttttagataaattttcagaggttaataaagaagttagtcgatacgtacatggaagtaaaggaattatagatgtaccaatattcaatactaaagatatgaagttagggctcggattatacctgattgactttattagaaaaagtgaagaccaaagcttcaaggagttttgctatggaaaaaatcttgcccctgtggatctggatagaatcataaactttgtttttcagccagagtaccatatacctaggatggtaagtacagaaaacttcaaaaaagttaagattagagaaatatccttagaggaggctgttacagcatctaattacgaagaaattaacaagcaggtcactaacaaaaaaattgctctccaggctctttttctttcgattactaatcaaaaagaggatgtcgccttatatatattatctaattttgagataactagacaagatgttatttccataaagcatgagttgtatgatattgagtatctacttagcgctcataattcaagctgtaaagtacttgagtattttatcaataagggattggttgatgtaaacacaaagttcaaaaaaactaatagtggggattgtatgttggataacgcaataaaatatgagaatgcagaaatgataaaactattattgaaatatggtgcaacatctgacaataaatatatttaatcaaaattgaatatcgtttagcaaaaggcagtatttgcacaaaatatcgatatattgtttattgtcagtatggctcaatgtgataatagttggaaagtttgatgggtttcgccccgttgtagcggtagtcgaactggaaggtcttcaggcactgcttacagcgatagagcagcccccctgaaccggaatggccgttccggataccccccctgagtttcagagtaacggggacaaaccacatcaatctttgccatcaatcatccaaagggcaaagagtacaacaacactaagtctgcgtcacaacccatcaatgaaaggaatatatacatatgccatcagtaaatttaatcccatcaaggaaaatatgtttgcaaaatatgataaataaagacaacgtctctgttgagacaatccagtctctattgcactcaaaacaattgccatatttttctgacaagaggagttttttattaaatctaaattgccaagttaccgatcactctggaagacttattgtctgtcgacatttagcttcctactggatagcacagtttaacaaaagtagtggtcacgtggattatcatcactttgcttttccggatgaaattaaaaattatgtttcagtgagtgaagaagaaaaggctattaatgtgcctgctattatttattttgttgaaaacggttcatggggagatattattttttatattttcaatgaaatgatttttcattccgaaaaaagcagagcactagaaataagtacatcaaatcacaatatggcattaggcttgaagattaaagaaactaaaaatgggggggattttgtcattcagctttatgatcccaaccatacagcaactcatttacgagcagagtttaacaaatttaacttagctaaaataaaaaaactgactgtagataattttcttgatgaaaaacatcagaaatgttatggtcttatatccgacggtatgtctatatttgtggacagacatactccaacaagcatgtcctccataatcagatggcctgataatttacttcaccccaaagttatttatcacgcgatgcgtatgggattgactgagctaatccaaaaagtaacaagagtcgtacaactatctgacctttcagacaatacgttagaattacttttggcagccaaaaatgacgatggtttgtcaggattgcttttagctttacaaaatgggcattcagatacaatcttagcatacggagaactcttggaaacttctggacttaaccttgataaaacggtagaactactaactgcggaaggaatgggaggacgaatatcgggtttatcccaagcacttcaaaatgggcatgcagaaactatcaaaacatacggaaggcttctcaagaagagagcaataaatatcgaatacaataagctgaaaaatttgctgaccgcttattattatgatgaagtacacagacagatacccggactaatgtttgctcttcaaaatggacatgcagatgctatacgcgcatacggtgagctcattcttagcccccctctcctcaactcagaggatattgtaaatttgctggcctcaaggagatatgacaatgttcccggacttctgttagcattgaataatggacaggctgatgcaatcttagcttatggtgatatcttgaatgaggcaaaacttaacttggataaaaaagcagagctgttagaagcgaaagattctaatggtttatctggattgtttgtagccttgcataatggatgtgtagaaacaattattgcttatgggaaaatacttcacactgcagaccttactccacatcaggcatcaaaattactggcagcagaaggcccaaatggggtatctggattaattatagcttttcaaaataggaattttgaggcaataaaaacttatatgggaataataaaaaatgaaaatattacacctgaagaaatagcagaacacttggacaaaaaaaatggaagtgattttctagaaattatgaagaatataaaaagctgaatattatctcgtggtgatacactgaatttgaggtaaccggctcatttaaaccgtctggtctgttacctccggttccacaaaaataatgtccatcattttgaagtggacactatcgtatggaataccggacctggatcactgaagctttacgccttcatttcgaagaacatttaccacgggttgtggccggacgtcgcctgggcgtaccaaaatcaactgtctgtggtatgttcgtgtgaaccgcccccggtatcccgctcatgctggcgaacccagacacgcagtgaaccgccccgggtttcctggagagtgttttatctgtgaaccacggcagcctggcggctgcaaatcggggtgtggcagaatatgagctttcagagtaaccatccagaatgagttcccatgtcacacaacctggagcaccagaaagtccacaccagaatggtgaaagaggttctgaaagccgtcgccagagccaataatcacccttataagtccgtatttgcagactttatcaccggtcatccctcctgcacggtctgtttctgggaaaccttccacaaaatgtacccggattcaccgtacgaatacgtcacgttctgccatacctgccgtcgttttgatttatacgaaacagaagcggagatgaaggcggatgacccgaagtggtggtgattttcagccccgaccgctgaaacgcctgttcacaaccaaccagtgctggacatccttcctggatgcgggcggtctgcgcgatatcgaggttgaggctgtcacaaaaatgctggcctgcggcacgcggatactgggcgtgaaggaatacaactgcgataaacctgagtgcccccacgtcagatacgtcactaactcatgcggcagccgtgcctgcccgtcctgcggaaaaaaggccacagacctgtggatagcgacacagctgaatcgtcttcctgactgcgactgggtacacctggtcttcatcctgccggacacgcagtggccggtgttcgaaagcaaccggtggctgctgaatgacgtgtgccgtctggcggtggagaatctgctgtatgccgcccggaaacgggggcaggaacccggtatcttctgcgccatccacacgtatggccgtcgtctcaactggcatccgcatgtacatgtgtctgtaacctgtggaggtctgaataagcatggtcagtggaaaaagctgagcttcctgaaagacgcgatgcgttcgcggtggatgtggaatatgcggcaacggcttctgaaagcgtggtcagaggggctggcgatgccggagtcgttgtcacatatcacgacggaatcacagaggagaagcctggtgctgaaagccggaggaaaatactggcatgtgtacatgtcgaaaaaaacggccggcgggaggaatacggcgcgctacctgggtcgttatctgaagaagccgccgatagcggcctcccggctggcacattacaacggaggggcgagcctgagcttccgttacctggaccacaaaacgggagaaacggcgacggaaacgctgacacagcgtgagctggtcgcgaggctgaaacagcacatcccggagaagttttttaagatggtgaggtacttcgggttccttgccaaccgggtgtgtggagagaagctgccgcaggtgtaccgtgctctggggatggataaaccggaaccagtggcgaaagtgtgctatgcacaaatggtgaaacagttcctgagtcgtgacccgttcgaatgcgtgctgtgtggcggccggatggtataccgccgggccatcgcgggactgaatgtggaggggctgaagaaaaacgcgcgggatatcagtctgctgaggtatatgccggcctgacacaggctaagtgtgcccgggaatcggtgcaagtataaaaaacagcctgttgcggtataagaatcgaccatgcagagagagaaaacaccggagtggagggaaaagcagaaaagctcacgtggcataaggcgtggacagcggtatcgtctggtttttcaatttcctatacgtgaacctgggtgccggccccggacgggaccgacggtttctgggatgtcgggtgtctgcccctgaaatacctcacacttccgtccccgcccggcagcttacttccgtgctgtcgggtagcagcgattcattactgacagatgtcaacgacggatgaaaagtgatccacttatatctccaccaacggcccaatattgatccaccgttttactcaggattagcttctgctataaccccggcctttcgtttctgtctgagtcgatagctttctcctttgatttgaacgacatgtgagtggtgtaagatacggcccagcatcgctgaggtcagtgctgcatcaccggcgaacgtttgatcccactgcccgaacggtagattggatgtcaggatcattgcgctcttttcgtaacgtttagcgatgacctggaagaacagttttgcttcttcctgactgaacggcagatagcctatttcatcaatgatgagcaggcggggggccattactccacgctgaagcgtcgttttataacggccctgacgttgtgccgtagataactgaagtaacagatctgctgctgttgtgaagcgaactttgatacctgcacggactgcttcatagcccatcgctattgccagatgggttttccccacacctgatggccccagtaatacgatattttcattacgttctatgaagctgagtgagcgtaacgactggagttgcttctgcggtgctccggtggcgaatgtgaagtcatactcttcgaacgttttcaccgccgggaaggctgccattcgggtatacatcgcctgtttacgttgatgacgtgccagtttttcttcatgaagcagatgctccaggaagtccatataactccattcctggtctactgcctgttgtgacagcgcaggcgctgcgcttaattaccccctagatctgatttcaggcgttgggtgtggatcactattgcaccgttcgtgacatgtgcgggagcctggtgtattgagtccttttcttgcggcggtaacccattgtcctaaagtgccttcaggaacagataatcgggtgaaccgccccgggaatcctggagactaaacttcctgagaaagaggtaaacaggatgactaaaaatactcgtttttcccccgaagtccgtcaacgggcagtccgtatggttctggaaagtcagggcgaatatgactcacaatgggcgacaatttgttccattgctccaaagattggctgtacgccggagactctgcgtgtctgggttcgccagcatgagcgggataccgggggcggtgatggagggctcaccaccgctgaacgtcagcgtctgaaagagccggaacgtgaaaatcgtgaactgcgccgcagtaacgatatccttcgccaggcttccgcttattttgcgaaggcggagttcgaccgcctctggaaaaaatgatgccactgctggataagctgcgtgagcagtacggggtcggaccgctatgcagcgaactgcatattgccccgtcaacgtattaccactgtcagcaacagcgacatcatccggataaacgcagtgcccgtgcgcagcgcgatgactggctgaagaaagagatacagcgcgtatacgatgaaaatcacaaggtatacggtgtaaagtctggcgtcagttgttacgggaaggtatcagagtggccagatgcactgtggcacgtctcatggcggttatgggacttgccggtgttctccggggtaaaaaggtccgtacgaccatcagccggaaagccgttgccgcaggcgaccgcgtaaaccgtcagttcgtggcagaacgacctgaccagctgtgggtggctgattttacttatgtcagcacatggcagggcttcgtctatgtggcgttcatcattgatgtgtttgccggatgcatcgtggggtggcgggtctcatcgtccatggaaacgacattcgtgctggatgcactggagcaggcgttatgggcccgtcgaccgtccggcacggtccatcacagtgataaaggttctcagtatgtatcgctggcctacacacagcggcttaaggaagccggattactggcatcaacaggaagtacaggcgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctggaaaggctgggccatactcctccggcagaagcagaaaagcttattatgcttccatcggaaacgatgatctggcagcctgagttcacagataaaacactctccaggaaacccggggcggttcaaagcgccagccccgtcccgcccgatagagcgcggcatagcgggccccggattacttgcgtgcgacggcagaagaagccctgaagcgaatcagtgaactgtacgccatcgaggatgaaatacggggattaccagagtcagagtgtcttgcagtcaggcagcagcgaagcaaagcgttactgacgtcgctgcatgaatggatggtggagaagaatggcacgctgtcgaaaaaatccagactgggcgaagcattcagctatgtactgaatcagtgggacgccctctgttattacagtgatgacggtctggcggaggcggacaataacacagcggaaagagcgcttcgtgcagtctgtctcggaaagaaaaattacgtgttcttcggtagcgatcacggcggcgagcgtggtgcactgctgtacgggctgatcggcacctgccgtctgaacggtatcgatccggaagcgtatctgcgccatattctgagcgtactgccggaatggccttccaaccgagttgacgacctcctgccatggaaggtggtgctaccatcaggataatcgtcaatacggtgttcggtgaacgtttacttggagcatcatgcttcatgaagaaaaactggcacgtcatcaacgtaaacaggcgatgtatacccgaatggcagccttcccggcggtgaaaatgttcgaagagtatgacttcacgttcgccaccggagcaccgcagaagcagctccagtcgttacgctcactcagcttcatagagcgcaatgaaaacatagtcttactggggacatctgacatcacaaatccccgggtggggatttgtgtataagagacagcccatggaggaaggagatatatcgcagctctgacgactcactccttatttacccgggaaatacttctccagcaatgcatacaggatggcagcggtttcagcatccattatgccgtcataatttttctgccggaaatgaagctgaaaagcgcggacaagcgccttatatccgtcatccgtctccacaccagaaatactgtatccataggtcttcagccgtgacacgatatcaaccttatccggaatgccctgcgattcaaaaaataaatatttagtcagtaattttatgtttttcctgaaaaaattactctttttcgaactccagtgagcgttcacgactcatcagtgtgaaaatgatggcaaaaacagcagacagtatcagtacgataaatgtggcccccatcccagataatcgacaacaagtcccattcccagtgtcgcaacaattgagccgaagatataggaaaatgtgcctgacagccctgatgcggctccggcagcttctttaggaacaagctccattgaataaagaccaataaacatcaccggaccatacactgccagccccaacagaataaggattgtatagtttagccagagatattcattgcctgatggcacgtaccagtacgcgattaataaaataatggtaagtgccagaaataaagtatttgttaatggttttgagtttctgaacagtctgacagacaggtatccggcaagaagcataccagccacaccaccgatttcaaaaacagaacccccccccattgatgccagttttcccatatccttaccaccgacatccagactgtcacttaaaaacttaggagcccaggaaacaataccgtatctcagaatataaacaaacgaaccatagatacagcagtaaatgagtttattatttcggatgatatgttttctgatgatatcaggaatggagagtctcggaccttgttcacggcctttagccgggtgtgaaacgacgttacctttccattcttcaatgggaggaagccccactgatacaggtctgtccacctgaataaagtaaatcagcacactcattgccatacacagtactcctgggaagataaatgcggcccgggcatgatccagagcactgtcgccgaaaaaaccaaaactgaaaccaatcagaacgggggccagagctcccccgacattgtgcgataaattccacagtgtggcccaggagatcctttcccgatgttcataccagaacaccagtgttttggcaccaggaggatatcccataccttggatccagccgttaagtaaatacgttgacggggcaatatgcagttcactgcataccggtccgaccccgtactgctcacgcagcttatccagcagtggcattattttttccagaggcggtcgaactccgcctttgcaaaataagcggaagccaggcgaaggatattgttactgcggcgcagttcacgattttcacgttccggctctttcagacgctgacgttcagcggtggtgagccctccatcaccgcccccggtatcccgctcatgctggcgaccccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcaggccagtacctcgtcagtcaactgacggtaaatctgctgttcagtctcacgcatcacctgtgcaccggcttccctctccgcatccgcatcaccgctcagacctgatgctttcagccggtcagccaccctctgagagtactcattctccagcatctcatacttctgctcttctgcctgcgcccagcggtcagcttccgtacgcttcagtacagcatgccatggtccccagagggagaaccagtccgtaaattcattctcttcacggcttctgaccatagcttcggcagtgcggaggtcatttgctgtcactcccgacacgccatagaaacgcatttccttcacggcagtggagagctgaagtttctctgcgagcatggtctggaaggccaggtagacttctatctcatccacaaaatggagagttctgactttatcccgggcaatatcctccagaatttcgaggcggaacatttccctgcccagggagagcagagcgccggtatcattatcgaaaaggccttctgatgcctgatggaccaggagggttttccggagattgttccatgtgagcgcgacacggtcctcacagctctcagtggcatcagcagcaacagcgaaagactgctgtcgaagctccgcagaggcactgagtttttccagccatgcagcgacctgttcacggaatccggaggtattgcgtgcagagacggtatcggaaaggcggtcaaggaacgcggaaaaggtgttggcatgctcttcatgttcaaaagcatgccatatctgtgatacatcagattgtttgttttccgggaaccatgctgtcacggcatcagccagggggcgatggagtgtattctgttgtccgtcactcatggagaagtaaatctgcgggccgtggtagtccggcgaagaggttaatctttgcagggattgcagaacgtgagtcgacaatggattccctgaaatgttaacattcgtacaaatgggcaatgtgattatattttcgggtaatgaagttagtaggttattggaaacatccagtgccaatagttcttgcggtaatctggataatctgcgtagttgattttcacctaccttcaaatattttaagctctgaggaaattctggtagttcctgtagtctgttgccggaaacaaagagttcttgtagtctatgaggcaattcaggcaagacagtaaggcgattaccttcaatacgtaatattgttagcgttgatggaagctctggtaacgtctccagactattaaaacgtgccgagagtgattgtaaatatggtggtaatgatggcagacatgacaaatttcgattgaatgaaatattaagcttaatcagttgagatggaagtgtcgggagtatattcaagttgttaccatttacatgaagttctgtcaaaagcggagaattttcaggtagggagattaactcattgttggaaatattaagttcacgtatatgcaaagggagtggtggtaaagaacgtagtttcagtaagcttaaattgagaacaggctcccgggtatccagacatattttcaataatcgaaccgcctggatgcgattttctgttgttgttccttccctagcccagtcatcccagatgcggtggtaatctctggtacactgttcttctaccgataaacgagatatacatgataagccacaaagggaacgaaaaaaagaatgattgttgatcggtttcatttattaacccctcactattcatatcttggtctattaatgcaaataaaacgagaaagtctttaaaaaaacaatcctagagctttatcggcgttttcattccggctggaggaatatgttcctgtctttccagtaaccgtcgattgttatatcagtctacccatgttaatgtgaccagttctactttcatccagtttggattgatctttatcccctatattttcaaacaatttttatcatttaactcattactgtctcgatattcccatagcaaacgatctggttggttatcccctcaaaaaagtcagttgcacgccgtaaatccctgccggtattgagcgaggatttacgggttgttgttaaggtccgtaatcgggtcacagtttttccggagtcaatccggtctgcggtttatgcttatgcgacgtgattatgaatggtgcagtcgtgagccgttttcagacaatcgcagggccagtacctcgtcagtcagctgacggtaaatctgctgttcagtctcacgcatcacctgtgcaccggcttccctctccgcatccgcatcaccgctcagacctgatgctttcagccggtcagccaccctctgagagtactcattctccagcatctcatacttctgctcttctgcctgcgcccagcggtcagcttccgtacgcttcagtacagcatgccatggtccccagagggagaaccagtccgtaaattcattctcttcacggcttctgaccatagcttcggcagtgcggaggtcatttgctgtcactcccgacacgccatagaaacgcatttccttcacggcagtggagagctgaagtttctctgcgagcatggtctggaaggccaggtagacttctatctcatccacaaaatggagagttctgactttatcccgggcaatgtcctccagaatttcgaggcggaacatttccctgcccagggagagcagagcgccggtatcattatcgaaaaggccttctgatgcctgatggaccaggagggttttccggagattgttccatgtgagcgcgacacggtcctcacagctctcagtggcatcagcagcaacagcgaaagactgctgtcgaagctccgcagaggcactgagtttttccagccatgcagcgacctgttcacggaatccggaggtattgcgtgcagagacggtatcggaaaggcggtcaaggaacgcggaaaaggtgttggcatgctcttcatgttcaaaagcatgccatatctgtgatacatcagattgtttgttttccgggaaccatgctgtcacggcatcagccagggggcgatggagtgtattctgttgtccgtcactcatggagaagtaaatctgcgggccgtggtagtccggcgaagaggttaatctttgcagggattgcagaacgcgagtcgacaatggattccctgaaatattaatcctgtaacttgaatctaattgtgaaaaactctccggaagagtggttatctgattaaaatgaaaataatattccttttgtctgatattgtttctatcagaaaattgaggaaaagtaaccagattattgcgctgagcacagagaatttccagtttatccggtaagtcgggtaatgttgtcagcctgttataataaacatgtaaaaatttcaatttttcgggaagagccggtaagttatatagcctgttattttcaacaaataatgatgttaaatggtttggcaaaacaggaaggttttccagttgattagaacgaacacttaaagttgttaatgactcaggaagttctggtatcacagaaagcctgttattatcagcattaagttctttaagaaatgcaggcagctttggcaatgatgttaatttattattttctacaatcaaagcagaaatatgctttggtaattcgggaagagacgtcaaatttaggtctgataaatttaatactgcttcttgattctgaaagcactgggagagtctgttaaaagcaatgcctcgctcttccccgggagaagagttcttttcccattcagtcaggattctcagataatgttcattactggttgagtttgagttaatagagggggagcaagaaactgatgagtgtgtattatttacagagaacataatgctaggtcaaccttatatttgtgagaataaatatttaaaattgtatatttatacaaatttcacttaccatttccgatattaagttttaatagtttccattttacacataacagaagttagttgtaatttatttatggaggttttctatggaattcttttttattgtgactgcagtcaataataacactgaattcaacattccagtgagcaaggaaatgtaatccgagtaagtatatttgttttacatcatattttagtcaagctcatttattcctattatagaataacaaattaaaattactgtaaaaaaacgatacacatttaatacgagggaggccggcagaaaaacggcttgcggtcaggcaggagaaatgtgtgccgcgaatgaagtccttgtatgactggataaagctccagaggaaaactttgtcaaaccatgctgaaatggtaaaggcgttcaactatatcctgaatcactggaatgcactgaatgagttttgccgggtagtacttccaatcattagaatatgtgcttttcaatgaaggaaccgatgactttttcgtggatttccacggaacgcgagaagcagattgttttacgtgccagccgcttgatgcgggggcggagggtcaggttgttacgttcatacgttgcgtgaagattttgccggtcaggtgtttctcctccggcacttctctggcgtagctgccccagtcatcgctggtcaccatgccgatacagaacggagtcaacagggctaacagttcccgacaggtctcatcattccgtggcccgcaagtgtaagccaacacaccgccagttttagtgttgtacgcataccagggccagtgttgttgcgccttgctgccaacgaagcgccactgctcatcaagttcacagataagggcaacatcagcgtgagcgactggcgcagatgttatccgccggggcgagagctttttaatgtccgtatgacggtattgatgccgattttcagtgttctggcggtataacagccccctgcgccgttatgtgccatttcaacgatctgctccttaacgccgagttttctggcttcataagagtaagtgagctggaaaacacgtttacatgagcgacaacggaaacgctcatgccgggaacaactacggccatgtcgataaacttcatcggaattacagcgcggacaatgaacagtaacggtagtcatggaaaacctcaaataccagtagattaccagaaacttctatcgattgaagacattaccttttgccgcaataggtggggtaacattggtgaaaacgcattacgccgggtggcagttggaaaaaaattatcttttttcggctctgatcgtggtggagaaaatgcggcaataatctaaatagctgcgcttaataccgctacacttttgccagcccatgtttgcctccggggaatgggctgacggtttccataaaatggcgaacttttttcaacagttgccacattgagcggcactgatgattacgcgttattgtgtcgtgaagtgcctgccatagccgttcaacatgattcacccatggcgagtaaaccggctgataaatgcccctgagcttcgggttctccttcagccagctctgtgtttcccggcttttgtggataatgtagttgtccacgatcagcgtgatggttttcgcacgacggtatgtcgctttaagccgcttcagcaggctgatgaacagcgccgaacttttgctgttgccgcccacatagctgactttacctgtcccgctgtgcagcgctccggccagataatatttttcattctgtcccggcgtgaccacccgtttttgctgtccgcgcagttgccagtccgcaccgattttgggatgaagatggatatccacttcatcttcataaaagaccggatgctctgcgctgcattcgtccagtgctttatggattgctgccatcttttcatctttatgcgggtcacggatacgcagagttggcgcagcccttcgccacacaatccccgcagacggcaaccagcggcgaacggttccggcatttaactggcaaccggttatctcattgatttttattgccagcagttctgtactccagcgtgaacgctggtagccaaagtcgccgggagaatgttttaccagctcacgtaacagtgtgcagatatgctcaaacggccagcgacgggcacgcccggcaggtaatgatttcagtccctcaacacccgactgcgtgaaccagttaatccagcgtccaacagaggaacgggcgcagcagagcgttctggcaacgtcgctgacacggtcgccccggtgcagcatcagcatggcagtcagtctgcgggcataatttttatcgtgtgttttatggatggctttctgcatcaggcgtcgttcgtcacgggaaattggtgctatgatcggcattgctcagtccggttggtgatttgttttgatttggcgattgatcagatcgcacaatccgggctaagttccctcaaagggatctactattccgcgcagctatttaggctgtgtcccttaattacgtaagcgttgataaaagagtcggatgcagcccagtttcaccatcgccaggtaatttctcgccgttttgtcgtaacgcgtggcgatgcggcgatattctttcagccgcccaaagcaccgttcaacgacattacgattgcagtacgcatcacgatcaagctgtgcacgtccatccgatgccattttctcatttgactttcgggggattactgcctttataccgttatttttcagctcgttgcgcaatgcgcgccctgaatacgctttatcagccagtaccgcatgtccacggcgtttcatgctgccgttctgacgctgaacgccaatcccgtccagaagtcgttgcgcgaactggctttcatgagcttgtccggggcttagcacgatatttaacgggaggccacttccgtctgttgccagatggattttggtgccaaaaccgccgcgagagcgacccggcccattatctccgtcgatatcgggatgtttttttgagcaccggcggcacatttcagcgcccggatattactgccatccagcgcggtggcagaccagtcaataaagccgtttgcatcaagtagcgaaagcaacctgttgaaaataatattaatcacgcctgactttgaccatcggttaaagcggttataaacagttttccatgccccatatcgttcgggtaaatcgcgccatggtgcaccggaacataacacccagaacatgccattgatgattttacggtgctcagcccatgggcgtccggcccgtggtgtggcgggttcaggaggtaacagaggcttgatgatggtccatgcctaatcgggaaggtcgtagcgagccatagttcacgtataggaaattgaaaaaccagacgataccgctgtccacgccttatgccacgtgagcttttctgcttttccctccactccggtgttttctctctctgcatggtcgattcttataccgcaacaggctgttttttatacttgcaccgattcccgggcacacttagcctgtgtcaggccggcatatacctcagcagactgatatcccgcgcgtttttcttcagcccctccacattcagtcccgcgatggcccggcggtataccatccggccgccacacagcacgcattcgaacgggtcacgactcaggaactgtttcaccatttgtgcatagcacactttcgccactggttccggtttatccatccccagagcacggtacacctgcggcagcttctctccacacacccggttggcaaggaacccgaagtacctcaccatcttaaaaaacttctccgggatgtgctgtttcagcctcgcgaccagctcacgctgtgtcagcgtttccgtcgccgtttctcccgttttgtggtccaggtaacggaagctcaggctcgcccctccgttgtaatgtgccagccgggaggccgctatcggcggcttcttcagataacgacccaggtagcgcgccgtattcctcccgccggccgtttttttcgacatgtacacatgccagtattttcctccggctttcagcaccaggcttctcctctgtgattccgtcgtgatatgtgacaacgactccggcatcgccagcccctctgaccacgctttcagaagccgttgccgcatattccacatccaccgcgaacgcatcgcgtctttcaggaagctcagctttttccactgaccatgcttattcagacctccacaggttacagacacatgtacatgcggatgccagttgagacgacggccatacgtgtggatggcgcagaagataccgggttcctgcccccgtttccgggcggcatacagcagattctccaccgccagacggcacacgtcattcagcagccaccggttgctttcgaacaccggccactgcgtgtccggcagggtgaagaccaggtgtacccagtcgcagtcaggaagacgattcagctgtgtcgctatccacaggtctgtggccttttttccgcaggacgggcaggcacggctgccgcatgagttagtgacgtatctgacgtgggggcactcaggtttatcgcagttgtattccttcacgcccagtatccgcgtgccgcaggccagcatttttgtgacagcctcaacctcgatatcgcgcagaccgcccgcatccaggaaggatgtccagcactggttggttgtgaacagacgtttcagcgggcggggagtaaaagcggacaacatgaggacggattaacccccggtatcctgtagccgggtaagggctgctgtgtcgccacggcgctccaggatggaggccgcgaccatcgcaggtggtgggtccatgggtttgagcatcttcatccagtcccattcacgttgtgagagcttctcagcaccaacagagagcagaacggtatctatacttttgcgggtcaacataagaggatgagtccttaataaaacaggtcctcagagcatacatattctgcggagcgtgcggcaacaacaggacgaacaggggcggttttcaatttgcagccgtcaggctgccgtggttctcgatatccaaactgccccttatcgataccgaactggcataactatttttaaagttgagcaagaagcttaagagaagagcatccccccagccaaactggctcaaaatgataaaaaaataacatcttgcgttttttttggttgtttttccgcttaccttaataaaaattatattacaccaactaaaaaacagatgcttaataattgatattagtagaatctcggactgctccatctacatcctatgtaattaatctttgtcaaaattaggttgatgtttctatatgaacaaaatatattatcttaagtattgccatataaccaaaagcctgattgctgtctccgaactggcccgcagggttacctgcaaaagccatcgcagactttcacgtcgggttattcttacgtctgttgcagctttatcactttcttcggcatggccagctctgtcagcaacggtcagtgcagagatcccttatcagatattccgcgactttgccgagaataaaggtcagtttacgccggggaccacgaatatttccatttacgacaagcagggcaatctggtcggtaaacttgataaagccccgatggctgatttcagtagtgccactattactaccggtagcctgcctccgggagaccatacactttactcccctcagtatgtggttaccgccaaacatgtcagcggttctgacacgatgagcttcggatacgccaaaaacacctatactgcggttggtacaaataataatagcggtcttgatattaaaacccgccgcctgagtaaactggtgacagaggtggcgccggcagaagtgtctgacatcggggctgtgagcggtgcctatcaggccggcggacgctttactgaattctatcgccttgggggggggatgcagtacgtcaaagacaaaaatggtaatcgcacccaagtgtataccaatggcggatttcttgttgggggaaccgtcagcgcgctgaactcctataacaacggacagatgattacagctcagaccggtgacatttttaatcccgcgaatggacctctggctaattatctgaatatgggggacagcggctcccccctgtttgcttatgattccctgcaaaaaaaatgggtactgattggcgtgctttcctcaggaactaactatggaaataactgggtcgtcaccactcaggatttccttggtcagcaaccgcaaaatgattttgacaaaactatagcctacacctctggtgaaggagtactgcagtggaaatatgatgcggctaatggcaccggcacactgactcagggaaacacgacttgggatatgcatggaaagaaaggaaatgatctgaacgcaggaaaaaacctcctgttcaccggcaataatggcgaggtcgttctgcagaattccgttaatcagggagctgggtatctgcagtttgccggcgattacagggtgtccgccctgaacggccagacatggatggggggcgggattatcaccgataaaggaacccacgttctgtggcaggtgaacggagttgccggtgataacctgcataaaactggcgaaggtaccctgacagtaaacgggaccggtgtgaatgcaggcggactcaaggtgggggacggtaccgttattctcaaccagcaggcggatgctgacggaaaggtacaggctttcagctctgttggtattgccagcggtcgtccgacagttgtgctttctgactcacagcaagttaatccggataatatttcgtggggataccgtggaggacgtctggaactgaatggtaataatctgacctttacccgtcttcaggcggctgactacggggccatcattaccaataacagtgagaaaaaatcaacggtaacactcgaccttcagacattaaaagccagtgacatcaatgtaccggttaatactgtcagtatttttggggggagaggagcgccgggagacctatattatgacagttctaccaagcaatatttcatcctgaaagcgagttcatattccccgttcttctccgatctgaacaacagcagtgtctggcagaatgtcggaaaagatcataataaagccattgatactgtgaagcaacaaaaaattgaggccagcagccagccttatatgtatcacggccaactaaacggcaatatggatgtgaatattccgcagctctcaggtaaggatgtactggctcttgatggttcagttaacctgccagaaggttcgataaccaagaagtccggcacgctgatattccagggtcatccagttattcatgctggaacgacgacttcttccagccagagcgactgggaaacccgtcagtttacgctggaaaaactgaaactcgatgcggcaacattccatctgtccagaaacggcaagatgcagggagatattaacgccaccaatggaagtacagtcattctgggaagtagccgtgtctttactgacaggagtgacggaaccggtaatgcggtctcctctgttgaagggagtgccactgcaaccacagttggtgaccagagtgattacagcggaaatgttacgctggaaaataaatcatccctgcaaatcatggagagattcaccggtggtattgaggcttatgatagcaccgtgagtgtgacctctcagaatgctgtttttgaccgtgttggcagctttgtcaacagcagcctgaccctcggaaaaggagcaaaacttacggctcagagcggtattttcagcaccggggctgtggatgtaaaagaaaatgcttctctgaccctgacggggatgccttctgcgcagaaacaggggtattactcacccgtaatttctacaacagaagggattaacctcgaagataacgccagcttttctgttaaaaatatgggctatctgagttcggatattcatgcaggaaccactgcggcaaccattaatctgggagacagtgatgctgatgcagggaagacggactctccgttattcagctccttaatgaagggatataacgctgttctgagaggcagtattacgggggcacagagtacggtaaatatgatcaatgctctgtggtactctgacggaaaatcagaggccggtgcactgaaggctaagggctcgcgaattgaactgggggacgggaaacactttgccactttacaagtaaaagagctttctgcagataataccacgttcctgatgcataccaacaacagccgggctgaccagttgaatgtcacagacaaactgtcaggcagtaataatagcgtcctggttgactttttaaacaaaccagccagtgaaatgagcgtgacgttaattaccgcaccgaaagggagtgatgagaaaacgttcactgccggtacgcagcagattggtttcagtaacgttacgccagtaatcagcacggaaaaaacggatgatgccacaaaatgggtgctgacaggatatcagactaccgctgatgccggagcctcgaaagccgcaaaagactttatggcatcaggttataagtccttccttacagaggtcaataacctgaacaaacgtatgggtgacctgcgggatactcagggggatgccggtgtctgggcacgcataatgaatggtaccggttcggcagatggtgactacagcgataactacactcacgttcagattggtgtcgacagaaagcatgagctggacggtgtggatttatttacgggggcattgctgacctatacggacagcaatgcaagcagccacgcattcagtggaaaaaacaaatccgtgggtggcggtctgtatgcctctgcactctttaattccggagcttattttgacctgattggtaaatatctccatcatgataatcagcacacggcgaattttgcctcactgggaacaaaagactacagctctcattcctggtatgccggtgctgaagttggttatcgttaccacctgacgaaagagtcctgggtggagccacagatagagctggtttacggttctgtatcaggaaaagcttttagctgggaagaccggggaatggctctgagcatgaaagacaaggattataacccactgattggccgtactggtgttgacgtgggaagagccttctccggagacgactggaaaatcacagctcgagccgggctgggttatcagttcgacctgctggcgaacggagaaacggttctgcaggatgcttccggagagaaacgtttcgaaggtgaaaaagatagcaggatgctgatgacggtagggatgaatgcggaaattaaggataatatgcgtttgggactggagctggagaaatcagcgttcgggaaatataatgtggataatgcgataaacgccaacttccgttatgttttctgacgaatgggataggcctgccattcggcaggcctttttctgaaagaactccgtgagcctgtttaagattctgtgtaaatgccttttctcagaagtgaccgtccaggtattagacgtcaactagttttgccgactggcgccaactatactggccgccccttcagtgcgacatcaagtcacgcttgttactgccttcgctgtctttttcctgtagctttcccctttcagttcgaacatatatccgtgatggatcagtcgatctgctgccgccaccgccatagtctcatccacgaagatgctgccccacatgctgaacggatggttactggttatcaccaggctcccacgttcatagcgatgcgctattaactcgaacagcacacccgtttcggcgctgtcgcgtttgacatagccaagatcatccaccactatcacccggtagcgatccagtttcagtagcagctcattcagtttcaactgagctctggctttacgtagttcctgcaacagctctcctgcgctgtagaaccgggcccggtagccctggcctactacgccatccacgatcgctgccgccagatggcttttccccaaccagctggccccgaacagcagaacgttttctccgcatcaacccagtctgtcgtttcacagagttgctggaactgagctccattcagttccggcaactgaatgaagtcgtattcgcttagcgttttggcaactggcaaccgggcctcctttttataacgacgcagtttttcactctcgcgccacaggagttctgtaagcgtcaacggaaggccgtattgacgcttatttatcggtgagaactacgttccatggcagcagttcgtcaactcggttggaaggccattccggcagtacgctcaggatatggcgcagatacgcttctggatcgataccgttcaaccgacagctcccgattagtccgtacagcagagctccgcgatcgcctccatgatcgctgccgaagaacatgtaattctttttcccgagacagacggtacgaagcgctctttctgctgtgttattgtccgcctccgccagaccgtcatcactgtaataacagagggcatcccactgattcagtacatagctgaacgcttcgcccagtctggattttttcgacagcgtaccattcttctccaccatccattcattcagcgacgtcagtaacgctttgcttcgctgctgcctgacggcatgaaccgccccgggtttcctggagagtgttttatctgtgaactcaggctgccagatcatcgtttccgatggaagcataataagctttttctgcttctgccggaggagtatggcccagcctttccagcaatcgtcgattgttataccagtccacccacgtgagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgcatccggcaaacacatcaatgatgaacgccacatagacgaagccctgccatgtgctgacataagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgcagcttatccagcagtggcatcattttttccagaggcggtcgaactccgccttcgcaaaataagcggaagcctggcgaaggatatcgttactgcggcgcagttcacgattttcacgttccggctctttcagacgctgacgttcagcggtggtgagccctccatcaccgcccccggtatcccgctcatgctggcgaccccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcagggacttccgtcccagccttgccagatgttgtctcagattcagattatgtcgctcaatgcgctgagtgtaacgcttgctgataacgtgcagctttcccttcaggcgtgattcatacagcggacagccatccgtcatccataccacgacctcaaaggccgacagcaggctcagaagacgctccagtgtggccagagtgcgttcaccgaagacgtgcgccacaaccgtcctccgtatcctgtcatacgcgtaaaacagccagcgctgacgtgatttagcaccgacgtagccccaatgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttcttgtgcgtaccgggctgagaggcggtgtaagtgaactgtagttgccatgttttacggcaatgagagcagagattgcgctgatgtccggcagtgcttttgccgttacgcaccacgccttcagtagcggagcaggaaggacatctgatggaaatggaagctacgcaagcaccttaaaatcaccatcatacactaaatcagtaagttggcagcattaccctctttttgttgagcgcccatgattctttcatttattgttactaattttttatgttatcatcatgttatgagcatgccctgttttgcgtctctattttatctatcatattctgagcattaactacataacaaggcgcaagatatatatccaaaaacaaataatactgttgcaataattcctttcagtaaaggaagtgtgattaaactcaggggatttcagagtgaaaatcgtacaacatattaaaatatgttcgttataatacatacaagaaaatattaagttagataatattattctaaataactgcagataaaaacgcacataatgggggatgttttatgaaaatacctgaagcagtaaatcatattaatgttcagaacaatattgatcttgttgatggaaaaataaatccgaacaaagatacaaaagcattacaaaaaaacatatcatgcgtaacaaactcatcctcttctggcataagtgaaaaacatttagatcactgtgctgatactgtgaaaagctttttaaggaagtctatagcagcgcaaagttatagtaaaatgttctctcaagggaccagtttcaaatcattaaatctttctattgaagcgccatctggagcacggtcatcatttcggtcacttgagcacctcgataaggtgtccagacactatctttctgaaataatacaaaaaactcatcctctttcttcggatgaacgtcacttgctctctattattattaattctgattttaacttcagacatcaaagtaacgctaacctgtcaaataatactcttaatattaagtcctttgataaaattaagtctgagaatatacaaacatataaaaacacattctctgaggatattgaagaaatagctaaccacgattttgttttttttggggttgaaatttccaatcatcaagaaacactcccactaaataaaacacatcatactgtggattttggtgctaatgcgtatatcattgatcatgactctccatatggatatatgacattaaccgaccactttgataatgctattccacctgttttttaccatgagcaccaatcatttttcttagataactttaaagaggttgtggatgaagttagcaggtatgtgcatggtaatcagggaaaaactgatgtgccaatatttaatactaaagatatgaggcttggaattgggttgcatcttattgattttataagaaagagtaaagatcaaagattccgagagttttgttataataaaaacattgatcctgttagtctggatagaattataaactttgtgtttcagcctgagtatcatataccaagaatgctaagcacagataacttcaaaaagataagactcagagatatatctttggaggatgccattaaagcatccaattatgaagaaattaacaataaggtgactgataaaaaaatggctcatcaagctcttgcttattctctaggcaatgcaaaatctgatatggcactttatttactatctaaatttaattttacaaaacaagatgtcgcagagatggagaaaatgaacaacaatatgtattgtgagctgtatgatgttgagtatttacttagtgaagatagtgccaactataaagtgctagaatattttattaataatggattggttgatgtaaacaaaagatttcaaaaagcaaatagtggggacactatgcttgacaatgcaatgaaaagcaaagattcaaaaacaattgattttttattaaaaaatggagcggtatcaggcaaacgatttgggaggtgacctaaaatatatttaggttgtgccctgaatctgacgttgtcatttttgttatattgatcgatataggggatggtgcagaccgttcccctgcaacaacacattgcatgtggtgaacgccccgggaatcctggagactaggctgtgtcccttaattacgtaagcgttgataaaagagtcggatgcagcccagtttcaccatcgccaggtaatttctcgccgttttgtcgtaacgcgtggcgatgcggcgatattctttcagccgcccaaagcaccgttcacgtataggaaattgaaaaaccagacgataccgctgtccacgccttatgccacgtgagcttttctgcttttccctccactccggtgttttctctctctgcatggtcgattcttataccgcaacaggctgttttttatacttgcaccgattcccgggcacacttagcctgtgtcaggccggcatatacctcagcagactgatatcccgcgcgtttttcttcagcccctccacattcagtcccgcgatggcccggcggtataccatccggccgccacacagcacgcattcgaacgggtcacgactcaggaactgtttcaccatttgtgcatagcacactttcgccactggttccggtttatccatccccagagcacggtacacctgcggcagcttctctccacacacccggttggcaaggaacccgaagtacctcaccatcttaaaaaacttctccgggatgtgctgtttcagcctcgcgaccagctcacgctgtgtcagcgtttccgtcgccgtttctcccgttttgtggtccaggtaacggaagctcaggctcgcccctccgttgtaatgtgccagccgggaggccgctatcggcggcttcttcagataacgacccaggtagcgcgccgtattcctcccgccggccgtttttttcgacatgtacacatgccagtattttcctccggctttcagcaccaggcttctcctctgtgattccgtcgtgatatgtgacaacgactccggcatcgccagcccctctgaccacgctttcagaagccgttgccgcatattccacatccaccgcgaacgcatcgcgtctttcaggaagctcagctttttccactgaccatgcttattcagacctccacaggttacagacacatgtacatgcggatgccagttgagacgacggccatacgtgtggatggcgcagaagataccgggttcctgcccccgtttccgggcggcatacagcagattctccaccgccagacggcacacgtcattcagcagccaccggttgctttcgaacaccggccactgcgtgtccggcaggatgaagaccaggtgtacccagtcgcagtcaggaagacgattcagctgtgtcgctatccacaggtctgtggccttttttccgcaggacgggcaggcacggctgccgcatgagttagtgacgtatctgacgtgggggcactcaggtttatcgcagttgtattccttcacgcccagtatccgcgtgccgcaggccagcatttttgtgacagcctcaacctcgatatcgcgcagaccgcccgcatccaggaaggatgtccagcactggttggttgtgaacaggcgtttcagcggtcggggctgaaaatcaccaccacttcgggtcatccgccttcatctccgcttctgtttcgtataaatcaaaacgacggcaggtatggcagaacgtgacgtattcgtacggtgaatccgggtacattttgtggaaggtttcccagaaacagaccgtgcaggagggatgaccggtgataaagtctgcaaatacggacttataagggtgattattggctctggcgacggctttcagaacctctttcaccattctggtgtggactttctggtgctccaggttgtgtgacatgggaactcattctggatggttactctgaaagctcatattctgccacaccccgatttgcagccgccaggctgccgtggttcaggcatttcattatcaaaatcacattaaacggccgtaatcagacatgatttgtgcgccgacacagatcatcgtcacaatgttcaggtctctgccattgtttttatcaggggatcgcttttcccgtaagtgattctgtatagcgttctgttaccatttgcgataacattaattgcatagcaaattgttaccaatggaggtttttatgtctacagctgcaagcgtccgtaaaacaccgcgagaacatcagattaacatccgggcaactgatgaggaacgagccgttattgattatgctgcgagcttggtcaataagaaccgtaccgatttcatcatggaactggcgtaccaggaagctaaaaacattatcctggatcaacgtttatttgtgctggataacgaacgttatgattcgtttattacgcaactggaagctcctgtgcagaatgcagaagggcgtgaacgtctgatggcggtaaagcctgaatggaaataaatgtcaccgcgccagcattgttgacggatgagcatatacttcagccatttgactgtggaaatgaggtgctaagtaactggttacgtggtcgggctatgaaaaaccagatgctcaatgcttctcgcacgttcgttatttgcttggaggatactttacgtattgtgggatactactcattagctactggttccgtcactcatgccgagcttggtcgcagtttgcggcataacatgcccaatcctgtccctgttgttctgttagggcgtctggctgttgatgtttgtacccaggggcatggtttcggtaaatggctactaagtgatgccattcaccgggttgtcaatctggctgatcaggttggcattaaggctgttatggtacatgcaattgatgatgacgccagagcattttatgagcgttttggttttgttcagtcagttgtggcacctaataccttgttttataaagtctgagtctgaggtagcctgagtttaacggacactccttcctgaaatagaatggcatcagaaggagccaataatgagcagaaaaaaccaacgttactctacggagtttaaagccgaagccgtcaaaacggttcctgaaaatcagctttcgatcagtgaaggcgcttcccgattatctcttcctgaaggcactttaggacaatgggttaccgccgcaagaaaagggctcaatacaccaggctcccgcacagtggctgagctggaatctgaagttatgcaactgcgtaaggctttaaatgaagcacgacttgagcgagatatattaaaaaaagcaacagcgtattttgcacaggagtcgctgaaaaatacgcgttagtcgaacaatggcgacaacaattccctgttgaagcgatgtgtcgggtacctggtgtatccaggagcggttattacgaccgggtacagcatgccccctcagacagaaaacaaagtgatgagcggctaaaactggagattaaggtggcacatatccgcactcgcgaaacatatggaacccggcggctccagacggagctggcagataacggaattatcgtcggttgaaccgccccgggtttcctggagagtgttttatctgtgaactcaggctgccagatcatcgtttccgatggaagcataataagctttttctgcttctgccggagggatgtggcccagcctttccagcaatcgtcgattgttataccagtccacccacgttagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacgggcccataacgcctgctccagtgcatccagcacgaatgtcgtttccatggacgatgagacccgccaccccacgatgcatccggcaaacacatcaatgatgaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccacagtgcatctggccactctgataccttcccgtaacaactgacgccagactttacaccgtataccttgtgattttcatcgtatacgcgctgtatctctttcttcagccagtcatcgcgctgcgcacgcagcttatccagcagtggcattattttttccagaggcggtcgaactccgcctttgcaaaataagcggaagccaggcgaaggatattgttactgcggcgcagttcacgattttcacgttccggctctttcagacgctgacgttcagcggtggtgagccctccatcaccgcccccggtatcccgctcatgctggcgaccccagacacgcagagtctccggcgtacagccaatctttggagcaatggaacaaattgtcgcccattgtgagtcatattcgccctgactttccagaaccatacggactgcccgttgacggacttcgggggaaaaacgagtatttttagtcatcctgtttacctctttctcaggaagtttagtctccaggattcccggggcggttcaggccagtacctcgtcagtcaactgacggtaaatctgctgttcagtctcacgcatcacctgtgcaccggcttccctctccgcatccgcatcaccgctcagacctgatgctttcagccggtcagccaccctctgagagtactcattctccagcatctcatacttctgctcttctgcctgcgcccagcggtcagcttccgtacgcttcagtacagcatgccatggtccccagagggagaaccagtccgtaaattcattctcttcacggcttctgaccatggcttcggcagtgcggaggtcatttgctgtcactcccgacacgccatagaaacgcatttccttcacggcagtagagagctgaagtttctctgcgagcatggtctggaaggccaggtagacttctatctcatccacaaaatggagagttctgactttatcccgggcaatatcctccagaatttcgaggcggaacatttccctgcccagggagagcagagcgccggtatcattatcgaaaaggccttctgatgcctgatggaccaggagggttttccggagattgttccatgtgagcgcgacacggtcctcacagctctcagtggcatcagcagcaacagcgaaagactgctgtcgaagctccgcagaggcactgagtttttccagccatgcagcgacctgttcacggaatccggaggtattgcgtgcagagacggtatcggaaaggcggtcaaggaacgcggaaaaggtgttggcatgctcttcatgttcaaaagcatgccatatctgtgatacatcagattgtttgttttccgggaaccatgctgtcacggcatcagccagggagtgttctggagcggaaattgtggcagaatttcccatagagaaaaatattcgaggaccagaataatctggtccggtggttatttgttgtagtgtacgcatggtatggccagacaatggattacctgcaacatttacgaaggcattctgagctaatctcaggacactttccggaagtgttgtcagattattattcattagcacagccctgttcatactaaaaggtaattccggtagttgttctataaaattattagccagagccagcccttcaagcttatctggaaaggggggaatgctgtctaatctgtttccagaaactaccagtaattttagttccggtggcaatagtggcagaatatgcaatcggttattatgaacccgtaaatgagttagattttcaggaagaaatggtaattcttttatcttgttatcacccgcattaagctcttctaacgtctcgggtaaggcaggtaagctttccagttgattaaattgagcatgtattaccttaagcattggtggtaaatcagggagatgtgttaataggttttttcttatttccagtgttgttatctgaggcggtaaatctggtaatgtttttaaatctaactcagataaatttaattctgcctcttgattttgtaaacatattttcagcctattgaaggcgatattgcgttgctcgcctggggtaccgttcttttcccattcgctccaggtttttaaataaaattcattacaagatggagtcagttccataggtaaagataatggagttaacgagtatacattgtttatttgatgcataatgccagaaccgattgcctgtatattggttgatttaatcattataactagaattcttatcaacgataagaattctagttaaatagaatatggcttattaattttaaaacagtttgctttgtaccctttctccgggtattgctttccccctaagccgtctatgggaaggagtctgctgttattcctgagaatggtaattcagccataaaaaggtatttaaggtcattgcgtctctccctatactcgaataatggtgaagaaagcatgatgaatatatcacgataacgttcagtacgtatcgaggatagatggagttactcctctctgaaatagaattactgctctattttttttctgttttcagaagttattagtaacaaaccctgatatatttttttgaaaatggagcttaaacgagtctgaaattaacttcagaaatcagaataccgttggctttgtttttcatcaattccggcttcatttatctttgtcaaccattgcatttctgtagcagtgaatttcaacgttttcgtccggctggcagcaggtatttgtaattcgtatatagctgcttttttattgaaaacagtatatccatctgtagtaacagtagaagataataatacaggatttgatacttcaaggatgatattttcttgtttttgtggaaggcaagggaatatagtttgtgtaagcatattacttccttatgttatattttggcaaaaaatttatttttttacattatagtcggctaaatgaagtttactgtaaaaaaacgatactttttcgggtggcgcttccaatcagtagaatatgtgtttttcaatgaaggagccgatgacttttcgtggatttccacggaacgcgagaagcagattgttttacgtgccagccgcttgatgcgggtgcggagggtcaggttgttacgttcaagatatagcatgtgctggatgaagatcccttttctggtcacctgtttatctttcgtggccgacggggtgacactgttaaaatgtaatgaacgcatcccacacaattaaacacggagtagtatgatggttaaaagggtgaaactggcaggtgtggagcctcgcagctttccggcatcatactgcccaatacgggatgcataaagcgtcctcagactggagactccacaaatgaaatatacaccggttggcgttgatatggcaaaacatgtcattcagattcacttcatcaatgagcacatgtcagcgccagtgatataagacggtaatggggatgcggacgatttcctggactctcagaagatgaaacatgtttactgaagaacaaaaaattcgcgctattgagctttatttcaaatatggtaagaagcttgaggtgtactggcaatagcggacaccaccatttgttctttttctaagcagtcatctgataatattttatcctgaaggctgccggggagatattccccagacgagagttgaggtagcctgagtttaacggacactccttcctgaaatagaatggcatcagaaggagccaataatgagcagaaaaaaccaacgttactctacggagtttaaagccgaagccgtcaaaacggttcctgaaaatcagctttcgatcagtgaaggcgcttcccgattatctcttcctgaaggcactttaggacaatgggttaccgccgcaagaaaagggctcaatacaccaggctcccgcacagtggctgagctggaatctgaagttatgcaactgcgtaaggctttaaatgaagcacgacttgagcgagatatattaaaaaaagcaacagcgtattttgcacaggagtcgctgaaaaatacgcgttagtcgaacaatggcgacaacaattccctgttgaagcgatgtgtcgggtacctggtgtatccaggagcggttattacgaccgggtacagcatgccccctcagacagaaaacaaagtgatgagcggctaaaactggagattaaggtggcacatatccgcactcgcgaaacatatggaacccggcggctccagacggagctggcagataacggaattatcgtcggttgaaccgccccgggtttcctggagagtgttttatctgtgaactcaggctgccagatcatcgtttccgatggaagcataataagctttttctgcttctgccggagggatgtggcccagcctttccagcaatcgtcgattgttataccagcccacccacgttagtgtggccagttccacttctgcacggtttttccagctcttacggtgtattacctccgctttgtaaagaccattgatgctctccgccatcgcgttgtcatacgagtcgcctgtacttcctgttgatgccagtaatccggcttccttaagccgctgtgtgtaggccagcgatacatactgagaacctttatcactgtgatggaccgtgccggacggtcgacggtgaagtggcacactgaatttggccacctgaacagaggtgatatgctcacctcagaacaacacaggtgctccaatgaaaaaaagaaattttagcgcagagtttaaacgcgaatccgctcaactggttgttgaccagaaatacacggtggcagatgccgccaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacgcattgaaatggagaatgaaatattaaaaaaggctaccgcgctcttgatgtcagactccctgaacagttctcaataatcgggaaactcagagcgcattatcctgtggtcacactctgccatgtgttcggggttcatcgcagcagctacagatactggaaaaaccgtcctgaaaaaccagacggcagacgggctgtattacgcagtcaggtacttgagctacatggcatcagccacggttcggccggagcaagaagcatcgccacaatggcaacccggagcggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggctcaccatgaaagcgctggaaatggcatgggaaacccgtggtaagcccggcggggtgatgttccacagcgatcagggcagtcattatacgagcaggcagttccggcagttattgtggcgataccagatcagacagagtatgagccggcgcggaaactgctgggataacagcctaatggaacgcttcttcaggagtctgaagaacgaatggatgccggtggtgggttacgtaagcttcagcgaggcagctcacgccataacggactatatcgttggatattacagcgcactaagaccgcacgaatataacggtgggttacccccaaacgaatcggaaaatcgatactggaaaaactctaactcggtggccagtttttgttgaccacttcatacaattaatatacattaagtaacaggcattcgagccttgatttgagaaagcctgtcattcatttgttttatgtagctatctatttcctctgatgcataactaaaaagttctcccatttcacgagcaataataatctcagatttaatagactttaatctctggcgactcatctcttaacacttgcataatctctctttttatatcatatagttctataaaccgatttgcccgtagttctccttggggagaatcatttctgaatacaacaattatatacaaaaaatcactattttctttagagaagatcttacaactaatctctgggagctcacataatgcatgtaagtcaggatggtacaaactatccacagaaaattgccccataggacgttttccagatataactgtcaaccagcttccttccggtgtactggcttcggctctggaaataggctgaaaatcttccggacatggagaatacattgtcttcatataattaagtcgtctggatttctcattaataaactcctctatttttaattgtgccatacttctggttataccagagatatacttcttgtcatatatgtttggtgattcattaaagtaaccatgttcaactctaggataaatatttctcactatatattcagtatttgcagtatttattggaaatacgttcttaatattcttgatgggactaatcattttaatctctatactcaaatataaacattaccatgaacaatataattgttcctaagtggaatgtctccacggagaacactttatctatcaggaaatagtgcgggcaacagtgtttaattatatcgagtgcgattacaatcgctggcgacggcaccgttggtgtggcggcctcagtccggaacaatttgaaaaccagaacctcgcttaggcctgtgtccatattacgtgggtaggctcacagagcctcacttacgactgcgtccatattatgtgggtaggatcaataaagacgttttatatgtgtctgcttgcagccagaaaatttataccctgcaggtatcataaacatgcttgataacttaattggggctccctcttccttttatggtgtaattgtttgattgaatacttccggggatttcagtatgaaatgaagtatatttaatatactttacaaaaagtttgtattagtggaataaggacaatagcttatccaaactgccaagcctctttattataagtaagatctggcactggaatattctcaaaaggactaacatcatcaccacgaccttcaaccaaccattttattgcatttaaatcccagaatagttcagtagtggtcaatttgggaaacgcacaatattgtacggttacgttatcgcaatagagtgaactctcgccctatacggcgttttcaaggattagtccttaatcggacaaccacattaaagcataataaataattaagctttaataatatactatagatacagttctattataaaaaatactattttaggtgatgcattaaattagtagaatatttattcttttataaaagcaccaatgaattgtccaagtaaacatgagataaaatgtgtagaggataactgagtttggtcactttaactgtattagtcgcagtctgactctcgactttaaaaggatgggaattacctgtactgatagtgagaaagctttccattgaaataagtcaaataaaagttgatggcttcagtgctaaagtgaggtgcccgctagccgtattcactcgaatcggaattcaatgtattgcttctgccatttccataatatttcacgggaaaaacaaaatctgaaaaactatacttaagtgttgtattgagtcagttgagatacaaatacatatttatcagcacacgttacgtcaaatacaggaggttgtcatgttggtactgaaaggcacgttggctattgcagccgtgatgacaatttattgtcttatcgttgttcttatggaacgcttttctgattgatttcatattggcgagagaacaagaaggtgagtagaattgtcgcggaatcctgaaactatcagcctcaggtatgaacaccaaaaggtaggtagagaaatctatggcccccgttactttattcgcacaatgaggtatttttttatttttacaaaagttcaataaatattataataaaagatatgttcttggtaacataaacaaatatttaattaaaataatgcttggcattgacgtttatcttataaagtaagaagatcatggacatttcaaccaaaaaagtagagttctcgatgaaattaaaattctttgtacttgcactttgtgtacctgcgatctttactacacatgctaccactaactatccacttttcataccggacaacatcagtacggatattagtctaggatctctgagtggcaaaacaaaagaacgcgtttatcatcccaaggaaggggggagaaaaattagtcaactggactggaaatacagtaatgcgactattgttagaggtggcatcgattggaagctaattccaaaagtgtctttcggagtttccggttggactactttaggtaaccagaaagcaagcatggttgataaagactggaacaattccaatacccctcaggtatggaccgaccagagctggcatcccaatacgcatctccgtgatgctaacgaattcgagctgaatcttaaaggttggttattaaataatttggattatcgacttggactaatagcaggttaccaagagagtcgttacagttttaatgcaatgggagggagttatatttatagtgaaaacggggggagcaggaataaaaaaggggcacatcctagtggtgaaagaacaataggttacaaacagctcttcaaaataccttatattggattaactgctaattaccgccatgagaattttgagtttggagcagaactgaaatatagtggttgggttctttcatctgatacagataaacactatcagactgagacaatttttaaagatgaaataaaaaaccaaaattactgctctgttgctgcgaatattggatactatgtcacccccagtgcaaaattttatatagaaggctccagaaattacatttctaataaaaaaggtgatacatctctttatgagcaaagtaccaatatatctggcaccattaaaaatagtgcaagtattgaatatattggttttctcacttccgcaggtataaagtatattttttgaattggttcaccgagttgattacgttttcatggctaaaaattgccgcccattgtgagtcatattcgccctgactttccagaaccatacgaactgcccgttgacggacttcgggggaaaaacgtgtatttttagtcattctgtttacctctttctcagggcgtttagtctccaggatttccggggcggttcaaaaaactcttcgttgattactgtggacttactgttggcattaccgaccctgagaccggagaaataagaaccgcttagatcatcgtggctgttctcggggtatcaagttacacatgggcagaggctacccaaggtctactattatcgcctgaaagcgctgatggaacagtgctatcagggac

SEQ ID NO: 204 - DNA, 1145 bp, Homo sapiens
  IL-18
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 205 - DNA, 2354 bp, Homo sapiens
  IL-11
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccttttgtttgttttttgagatggagtctcgctctgttgcctaggctggagtgcagtgaggcaatctgaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagttcgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaat

SEQ ID NO: 206 - DNA, 1201 bp, Homo sapiens
  IL-6
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaaaaaaaaaaa

SEQ ID NO: 207 - DNA, 1450 bp, Homo sapiens
  IL-12A
tttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgaaaaaaaa

SEQ ID NO: 208 - DNA, 2943 bp, Homo sapiens
  IL-1A
accaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacaaaaaaaaaaaaaaaa

SEQ ID NO: 209 - DNA, 822 bp, Homo sapiens
  IL-2
agttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaaaaaaaaaaaaaaaaaaaaaaaaa

SEQ ID NO: 210 - DNA, 614 bp, Homo sapiens
  IL-4
gatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 211 - DNA, 1718 bp, Homo sapiens
  IL-8
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 212 - DNA, 1629 bp, Homo sapiens
  IL-10
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 213 - DNA, 1234 bp, Homo sapiens
  MIP-2
gagctccgggaatttccctggcccgggactccgggctttccagccccaaccatgcataaaaggggttcgccgttctcggagagccacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaatataaaaaaaaaaaaaaaaaaaaaaaaaaaaaaaaa

SEQ ID NO: 214 - DNA, 1062 bp, Homo sapiens
  Thrombopoietin
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaa

SEQ ID NO: 215 - DNA, 1237 bp, Homo sapiens
  RANTES
gctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 216 - DNA, 813 bp, Homo sapiens
  MIP-1 alpha
agctggtttcagacttcagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggtaaaaaaaaaaaaaaaaaaa

SEQ ID NO: 217 - DNA, 667 bp, Homo sapiens
  MIP-1 beta
agcacaggacacagctgggttctgaagcttctgagttctgcagcctcacctctgagaaaacctctttgccaccaataccatgaagctctgcgtgactgtcctgtctctcctcatgctagtagctgccttctgctctccagcgctctcagcaccaatgggctcagaccctcccaccgcctgctgcttttcttacactgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 218 - DNA, 1119 bp, Homo sapiens
  GRO alpha
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaaaaaaaaaaaa

SEQ ID NO: 219 - DNA, 1166 bp, Homo sapiens
  GRO gamma
gctccgggaatttccctggcccggccgctccgggctttccagtctcaaccatgcataaaaagggttcgccgatcttggggagccacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaaaaaaaaaaaa

SEQ ID NO: 220 - DNA, 1173 bp, Homo sapiens
  ENA-78
cggcacgagcacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcagggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtctacagcagagaagttttctggaggtctctgaacccagggaagacaagaaggaaagattttgttgttgtttgtttatttggtttccccagtagttagctttcttccctggattcctcacttttgaagagtgtgaggaaaacctatgtttggcgcttaagctttcagctcagcttaatgaagtgtttagcatagtacctctgctatttgctgttattttatctgctatgctattgaagttttggcaattgactatagtgtgagccaggaatcactggctgttaatcttacaaagtgtcttggaattgtaggtgactattatttttccaagaaatatcccttaagatattaactgagaaggctgggggtttaatgtggaaatgatgtttcaaaaggaatcctgtgatggaaatacaactggtatcttcacttttttaggaattgggaaatattttaatgtttcttggggaatatgttagagaattcccttactcttgattgtgggatactatttaattatttcactttagaaagctgagtgtttcacaccttatctatgtagaatatatttccttattcagaatttctaaaagtttaagttctatgagggctaatatcttatcttcctataattttagacattgctttaactttttagtaaaaaaaaaaaaaaaaaaaaaaaaaaaa

SEQ ID NO: 221 - DNA, 1307 bp, Homo sapiens
  LDGF-PPBP
acttatctgcagacttgtaggcagcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcatcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctctaattcttgcctaaacattggactgtactttgcatttttttctttaaaaatttctattctaacacaacttggttgatttttcctggtctactttatggttattagacatactcatgggtattattagatttcataatggtcaatgataataggaattacatggagcccaacagagaatatttgctcaatacatttttgttaatatatttaggaacttaatggagtctctcagtgtcttagtcctaggatgtcttatttaaaatactccctgaaagtttattctgatgtttattttagccatcaaacactaaaataataaattggtgaatatgaatcttataaactgtggttagctggtttaaagtgaatatatttgccactagtagaacaaaaatagatgatgaaaatgaattaacatatctacatagttataattctatcattagaatgagccttataaataagtacaatataggacttcaaccttactagactcctaattctaaattctacttttttcatcaacagaactttcattcattttttaaaccctaaaacttatacccacactattcttacaaaaatattcacatgaaataaaaatttgctattga

SEQ ID NO: 222 - DNA, 1677 bp, Homo sapiens
  GCP-2
accccttctttccacactgccccctgagttcagggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagacgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatatagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccaaaaaaaaaaaaaaaaaaa

SEQ ID NO: 223 - DNA, 476 bp, Homo sapiens
  PF4
ccatcgcactgagcactgagatcctgctggaagctctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatc

SEQ ID NO: 224 - DNA, 2545 bp, Homo sapiens
  Mig (CXCL9)
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 225 - DNA, 3545 bp, Homo sapiens
  SDF-1alpha/beta
gccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtagccaccaa

SEQ ID NO: 226 - DNA, 2719 bp, Homo sapiens
  Gelsolin isoform a precursor
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 227 - DNA, 3286 bp, Homo sapiens
  LKB1 (STK11) serine/threonine kinase 11
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctgaaaaaaaaaa

SEQ ID NO: 228 - DNA, 1968 bp, Homo sapiens
  RASF1 Ras association (RalGDS/AF-6) domain family member 1
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaa

SEQ ID NO: 229 - DNA, 5426 bp, Homo sapiens
  RASSF2 Ras association (RalGDS/AF-6) domain family member 2
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcagcctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 230 - DNA, 1337 bp, Homo sapiens
  RASSF3 Ras association (RalGDS/AF-6) domain family member 3
gctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaa

SEQ ID NO: 231 - DNA, 2509 bp, Homo sapiens
  RASSF4 Ras association (RalGDS/AF-6) domain family member 4
ctgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtgagaaaaaaaaaaaaaaaa

SEQ ID NO: 232 - DNA, 3637 bp, Homo sapiens
  RASSF5 Ras association (RalGDS/AF-6) domain family member 5
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcatgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcatgttaaaaaaaaaaaaaaaaaa

SEQ ID NO: 233 - DNA, 4268 bp, Homo sapiens
  RASSF6 Ras association (RalGDS/AF-6) domain family member 6
agcccggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagcaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagtcggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcgcctataatgccagctactcgggaggctgaggcaggagaatcgcttgaacccgggaggcggaggttgcatgagccgagatggcgccactgctctccagcctggacgacagagcaagactccgtctct

SEQ ID NO: 234 - DNA, 1554 bp, Homo sapiens
  RASSF7 Ras association (RalGDS/AF-6) domain family member 7
ggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagcttgaaaaaaaaaaaaaaaaaa

SEQ ID NO: 235 - DNA, 5882 bp, Artificial Sequence
  RASSF8 Ras association (RalGDS/AF-6) domain family member 8
gtctttagtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgttgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgttttttttaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggcattacaaaaaaaaaaaaaaaaaaaa

SEQ ID NO: 236 - DNA, 5072 bp, Homo sapiens
  SYK Spleen tyrosine kinase
actctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgaaaaaaa

SEQ ID NO: 237 - DNA, 931 bp, Homo sapiens
  TIMP-1
tttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaaaaaaaaaaaaaaaa

SEQ ID NO: 238 - DNA, 3670 bp, Homo sapiens
  TIMP-2
cgcagcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaa

SEQ ID NO: 239 - DNA, 5496 bp, Homo sapiens
  TIMP-3
ctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaaaaaaaaaaa

SEQ ID NO: 240 - DNA, 1667 bp, Homo sapiens
  TIMP-4
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaaaaaaaaaaaaaaaaaaaaaaaaaaaaaaaaaaaa

SEQ ID NO: 241 - DNA, 1455 bp, Homo sapiens
  BRMS-1
aagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggactctggaaaaaaaaaaaaaaaaaa

SEQ ID NO: 242 - DNA, 3155 bp, Homo sapiens
  CRMP-1
gcaccgaggcgcggagcgcggcgcacggcggtgcccagggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggcggcatgttcgccgcggtggagggcgcctacgagaacaagaccatcgacttcgacgcctacagtgtgggccgccgcggctcggcgcgcacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcaaaaaaaaaa

SEQ ID NO: 243 - DNA, 5227 bp, Homo sapiens
  CRSP3/MED23
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccgtgtgattgtttcccg

SEQ ID NO: 244 - DNA, 2358 bp, Homo sapiens
  CTGF
aaactcacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaaaaaaaaaaaaaaaa

SEQ ID NO: 245 - DNA, 1467 bp, Homo sapiens
  DRG1
cctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgcaaaaaaaaaaaaaaaaaa

SEQ ID NO: 246 - DNA, 1715 bp, Homo sapiens
  KAI1
ggcctgccgagtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaa

SEQ ID NO: 247 - DNA, 731 bp, Homo sapiens
  KiSS1 (kisspeptin)
gagaactcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgcggggcgggggcggggggcggggacgtagggctaagggagggggcgctggagcttccaacccgaggcaataaaagaaatgttgcgtaactcaaaaaaaaaaaaaaaaaa

SEQ ID NO: 248 - DNA, 3752 bp, Homo sapiens
  Mkk4
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgaaaaaaaaaa

SEQ ID NO: 249 - DNA, 1519 bp, Homo sapiens
  Mkk6
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactagggggcaggtcaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatatgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagaaaaaaaaaaaa

SEQ ID NO: 250 - DNA, 3386 bp, Homo sapiens
  Mkk7
gcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttccaaaaaaaaaaaaaaa

SEQ ID NO: 251 - DNA, 1507 bp, Homo sapiens
  RKIP
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaaa

SEQ ID NO: 252 - DNA, 1216 bp, Homo sapiens
  RhoGDI2
ctcattgacttccttcctgttctaactgccagtactcagaagtcagagttgagagacagaggcaccccggacagagacgtgaagcactgaataaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgag

SEQ ID NO: 253 - DNA, 8450 bp, Homo sapiens
  SSeCKS
gggactcggactcgctcctgggcgagctgaaagtcggctgcagcagaagctcctgccttgggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataatttttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtcgaagacaatatttgattcctagttctgtttggggcaaattttcatttatctaaataaaatgcaatctaattaaatgccatggattttctttctgtaaaaaaaaaaaaaaaaaa

SEQ ID NO: 254 - DNA, 2953 bp, Homo sapiens
  TXNIP/VDUP1
atatagagacgtttccgcctcctgcttgaaactaacccctctttttctccaaaggagtgcttgtggagatcggatcttttctccagcaattgggggaaagaaggctttttctctgaattcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaaaaaaaaaaaaaaaaaaaaa

SEQ ID NO: 255 - DNA, 820 bp, Homo sapiens
  nAG Notophthalmus viridescens anterior gradient protein 2
cacgagtggagcacttccccagcacgcaagacaagtgcaggtgggagaccaagccatcgctcaacatggtgaaaggttacctggcagctcttctgctcctagcgctttcttcattcagcctagccaaagagagcgccaagagaccggaagtgaagaaggtccagactctttcgagggggtggggcgacagtctcgaatgggctcagacgtatgaggaaagcctgtccaaatccaggagcagcaacaaaccactgctcgttatcaaccacagagatgactgtccacactctcaagctttgaagaaagcatttgctgagcacaaaggcatccagaaactcgcagagaagttcattcttcttaacgttgttcatgatccaactgacaagaaccttgtacttgatggcatgtatgtacccaagcttgttttcgtagatccatctatggtagtgagagctgatcttcctggaaaatactccaatcatcggtacacctatgagcctgcagacattgatctgttgtatggtaacatgcagaaagcactcaaacttctgaaaactgaactgtgagcgaagaatgcctagacaagtgacccccgcatcctgtttccgcatgagactgcacaaccagaaagttgacttcagttgatttgaaattcatgaagacactgtaaaagcataactgggattatgattcatctggctgtaaacacttcctggcattttgacgtttgactgtgctagatttttttaaaatgtattctttatgcttcatctgtaagcaacacatttttaaataaatccatttttgggtatttattatt

SEQ ID NO: 256 - DNA, 1411 bp, Homo sapiens
  Oct4 (POU5F1) POU class 5 homeobox 1
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 257 - DNA, 2098 bp, Homo sapiens
  NANOG
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacat

SEQ ID NO: 258 - DNA, 1255 bp, Homo sapiens
  Ngn3 (NEUROG3) Neurogenin 3
gataaagcgtgccaaggggcacacgacttgctgctcaggaaatccctgcggtctcaccgccgcgcctcgagagagagcgtgacagaggcctcggaccccattctctcttcttttctcctttggggctggggcaactcccaggcgggggcgcctgcagctcagctgaacttggcgaccagaagcccgctgagctccccacggccctcgctgctcatcgctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctggctgacccctggccggcccaggcctccacgggggcggcaggctgggttcattccccggccctccgagccgcgccaacgcacgcaacccttgctgctgcccgcgcgaagtgggcattgcaaagtgcgctcattttaggcctcctctctgccaccaccccataatctcattcaaagaatactagaatggtagcactacccggccggagccgcccaccgtcttgggtcgccctaccctcactca

SEQ ID NO: 259 - DNA, 4833 bp, Homo sapiens
  Myc-CTR1
atggaggagcagaagctgatctcagaggaggacctgggcgggagggggcgggaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctaaaaaaaaaaaaaaaaaaaa

SEQ ID NO: 260 - DNA, 1122 bp, Homo sapiens
  FCU1 FCY1-FUR1 fusion
atggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagtcttcggaaccatttaagaacgtctacttgctacctcaaacaaaccaattgctgggtttgtacaccatcatcagaaataagaatacaactagacctgatttcattttctactccgatagaatcatcagattgttggttgaagaaggtttgaaccatctacctgtgcaaaagcaaattgtggaaactgacaccaacgaaaacttcgaaggtgtctcattcatgggtaaaatctgtggtgtttccattgtcagagctggtgaatcgatggagcaaggattaagagactgttgtaggtctgtgcgtatcggtaaaattttaattcaaagggacgaggagactgctttaccaaagttattctacgaaaaattaccagaggatatatctgaaaggtatgtcttcctattagacccaatgctggccaccggtggtagtgctatcatggctacagaagtcttgattaagagaggtgttaagccagagagaatttacttcttaaacctaatctgtagtaaggaagggattgaaaaataccatgccgccttcccagaggtcagaattgttactggtgccctcgacagaggtctagatgaaaacaagtatctagttccagggttgggtgactttggtgacagatactactgtgtttaa

SEQ ID NO: 261 - DNA, 4576 bp, Homo sapiens
  HACE1 HECT domain and ankyrin repeat containing, E3 ubiquitin protein ligase 1
agaaggccacgcgagcccgggagggacgcggcggcgggggctgcaggaaaggcgcgagcagaggcggcggcgggtgtactgtaggtggtcggtccggcagcagcccggcccccggacgcaggacgtggccccaggcagccctcgcagctcagtgctctagccggggcaagcccgcgtctccgcctgctggacgggcccaggcgagatgtagggctctgggcgcggaggccgccggtggggcggctgatcgcggaggatcgcggagggcgcgccgaggatggagagagcgatggagcaactcaaccgcctgacgcgctcgctgcgccgcgcgcgcaccgtggagttgcccgaggataatgaaactgctgtttatacattaatgccaatggttatggctgatcaacacaggtctgtttctgaactactatcaaattcaaaatttgatgtcaattatgcattcggacgtgtgaaaagaagcttgcttcacattgcagcaaattgtggatcggtggaatgcttggttttgctgttaaagaaaggagcaaatcctaactatcaagatatttcaggctgtacaccccttcatttggcagcaagaaatgggcagaagaaatgtatgagtaaattattagaatatagcgctgatgtcaacatttgtaataatgaaggccttacagcaatacattggctggctgtgaatgggcggacagaactactccatgaccttgtgcagcatgtcagtgatgttgatgttgaggatgccatggggcagacagcactgcatgttgcctgccagaacggtcacaagacgacagtgcagtgcttgctagacagtggtgctgatattaacaggccaaatgtatcaggagcaactccattgtactttgcttgcagtcatggtcagagagatacagcacagatcctactattacgaggagccaaatatctgccagataaaaatggagtaactcctctggatttatgtgtacagggtggatatggagagacttgtgaagtattaattcaatatcacccgaggctttttcagactattattcaaatgacacagaatgaagacctccgagaaaacatgttacggcaagttctggagcatttgtctcagcaaagtgaaagccagtacctaaagattctaacaagccttgctgaagttgctacaacaaatggtcataaactgcttagcctctctagcaattatgatgctcaaatgaagagccttttaaggattgtgagaatgttttgtcacgtctttcgaattggtccatcctcccccagtaatggaattgatatgggctacaatgggaataaaactccaagaagccaggtgttcaagcctctggaattgctttggcactcgttagatgaatggctagttttaatagccacagaattgatgaaaaacaaaagagactcaacagagatcacttctattttactgaaacaaaaaggccaagatcaagatgctgcttccattcctccatttgaacctccaggacctgggagctatgaaaatctgtccactggcacaagggaatctaaaccagatgctcttgcagggagacaggaagccagtgcagattgtcaggatgttatttctatgacagctaaccggctaagtgctgtcattcaagctttttacatgtgctgttcttgtcagatgcctccgggaatgacttcacctcgtttcattgaatttgtctgcaaacatgatgaagttttaaaatgctttgttaatagaaatcccaaaattatatttgaccactttcactttctccttgaatgtcctgagttgatgtcaagattcatgcatatcataaaagcacagccttttaaagatcgctgtgaatggttctatgaacatttgcattcaggacagccagattcagatatggtgcacaggccagtgaatgaaaatgatatcctgctggttcacagagattctatttttaggagtagctgtgaagttgtgtcaaaagcaaattgtgcaaagctaaagcaagggattgctgtacggttccatggagaagaaggcatgggtcaaggtgttgtgcgtgagtggtttgatattctgtccaatgagatagtcaatcctgattatgcattgtttacccagtcagctgatggaacaacttttcagcctaatagcaactcttatgtaaatcctgatcacttgaactattttcggtttgctgggcagatcttgggattagcgttgaaccacaggcagctggtcaatatttacttcacacgatccttctacaagcacattcttggtattcctgtaaattaccaagatgtggcatccattgatccagaatatgcgaaaaatttgcaatggattttagataatgatataagtgatctgggtctagaactaactttttctgttgagactgatgtgtttggagcaatggaagaggtgcctttgaaacctgggggtgggagtattcttgtgacacaaaataataaagcggagtacgtccagcttgttactgaacttcgaatgacaagagccattcagcctcagatcaatgcttttttacagggctttcatatgttcattccaccctccctcatacagctttttgatgaatatgaattggagctactgctttctggcatgccagaaattgatgtgagtgattggataaaaaatacagaatacacaagtggctatgaaagagaagatccagttattcagtggttctgggaagttgtagaagacattactcaagaggagagagttcttctcttacagtttgttacgggcagttccagggtcccacatggtgggtttgctaatatcatgggtggaagtggattgcaaaactttacaatcgctgctgtgccatatactccaaatcttttaccaacttcaagcacatgcatcaacatgctcaagttacctgaatacccaagtaaagaaatactcaaggacagacttcttgtggcactacattgtggcagctatggttacacaatggcataatgaagtctggaaaactcctctgactactgatgcacaattcagaatggcagaagtaatttgggaaaatgtcaacaaaaaagcagcctaaatgcaacccataggcagggctgatgcttccaatttataaaggatcatcaggttttctgtttctctcttttcccttttatgttttctctgtttgtgatacaattagaaaatataaaatcacagtagattttattttttaaaatgctaactgaaagtaatagagactgtcctttttcataattaattttatccaagattgtattaaggcaaaatctgattctacattccacctctgctatgtaactgtcttgttaaaagggtgttttctcctaatttctgatatattatatgaggtcatccagctggtgtgttcttttgcatgtaaactgccatttatattttagaaaactattgtatagaatggatttagattgtctataaagccacaaatacgtattttgccacagtgtattctatattgcaatgatttttttagcattttaatattttaatatatattgtaaaatttagactgatgatactaacagttgatgaaatgacatataatttatatatgaaagcttacgctatattgtatgaattatttgcatctttcagtggccagttttccatatgtatatattatggtctcaatgtttttcttacgcctcattttaatttataatgaaggtaaaattaaaatgtattttaccacgtttcttttcattacttttatctgtgagctctgacacatctgaaaaagtaatctgatgtgcaaattataatttaaatatgttaatttttttgcttcttaaatttgcttttcatcattaaaatgtcaagttcaagtgatatgtgcctaatatcacttggatgttggtgggtttttgaatttttgggtggttaatcagttttattttgaaaagacgtacttgaatagttacagcatatgtttgaacaggaagtaggaacatgcatacacgaagaaatgctaacggaaggatttgttatgtttaggatcttcccttggaaactaaaaatagaatattaatgacattactgtttgtagaatgacatatgcagattttctcataagcagtcattgtgtttgccagtaatgtttgagagacatgtaagttgaaagttttgctaaattataaagctcctttaattcgttggttttgattctcttattctcttgtcttttctaaatgttaacaaaatatatcttaacagattacatgaaatttaggaattatttaaaagttaccattagctctaaaattaagattcggatgctttatttatagtaactgaagctaataatgttttatgttttgattttttgaaatttaattgtagaagtcactgccttctgagttttcaaatagataaccacctttaatattacactgcttataatactaatgtttacagatatgtttctgtttataaccatataatacattggctttgtcatattagttttttttgcaagtagttatgtaaaagagatagataataaaatattaaataactgag

SEQ ID NO: 262 - DNA, 858 bp, Homo sapiens
  nppa1 Natriuretic peptide A
gagacagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaaaaa

SEQ ID NO: 263 - DNA, 27745 bp, Homo sapiens
  CPG2 (SYNE1) Spectrin repeat containing nuclear envelope 1
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 264 - DNA, 3053 bp, Homo sapiens
  WT CDC6 wildtype cell division cycle 6 homolog
gagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatgg

SEQ ID NO: 265 - DNA, 1957 bp, Homo sapiens
  BMP4 Bone Morphogenetic Protein 4
aagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaaaaaaaaaaaaaaaaa

SEQ ID NO: 266 - DNA, 150 bp, Vaccinia virus
  Vaccinia F14.5L
tcaatatagcaacagtagttcttgctcctccttgattctagcatcctcttcattattttcttctacgtacataagcatgtccaatacgttagacaacacaccgacgatggcggccgccacagacacgaatatgactagaccgatgaccat

SEQ ID NO: 267 - DNA, 2977 bp, Homo sapiens
  WT1 Wilms tumor 1
agctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaa

SEQ ID NO: 268 - DNA, 2586 bp, Homo sapiens
  p53 Tumor protein p53
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 269 - DNA, 1267 bp, Homo sapiens
  Arf or CDKN2A or p16 Cyclin-dependent kinase inhibitor 2A
cgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 270 - DNA, 891 bp, Homo sapiens
  Bax BLC2-associated X protein
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttt

SEQ ID NO: 271 - DNA, 7224 bp, Homo sapiens
  BRCA1
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 272 - DNA, 6132 bp, Homo sapiens
  CFTR Cystic fibrosis transmembrane conductance regulator
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaa

SEQ ID NO: 273 - DNA, 9048 bp, Homo sapiens
  Factor VIII
gcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaaaaaaaaaaaaaa

SEQ ID NO: 274 - DNA, 5292 bp, Homo sapiens
  low density lipoprotein receptor LDLR
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaaaaaaaaaa

SEQ ID NO: 275 - DNA, 1418 bp, Homo sapiens
  Alpha-galactosidase
aaacaataacgtcattatttaataagtcatcggtgattggtccgcccctgaggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgtttattttattgcc

SEQ ID NO: 276 - DNA, 2324 bp, Homo sapiens
  beta-glucocerebrosidase
atcacatgacccatccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccagtca

SEQ ID NO: 277 - DNA, 469 bp, Homo sapiens
  insulin
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaa

SEQ ID NO: 278 - DNA, 828 bp, Homo sapiens
  parathyroid hormone
aaaagtcaccatttaaggggtctgcagtccaattcatcagttgtctttagtttactcagcatcagctactaacatacctgaacgaagatcttgttctaagacattgtatgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactcaaaaaaaaaaaaaaa

SEQ ID NO: 279 - DNA, 3220 bp, Homo sapiens
  alpha-1-antitrypsin
acaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 280 - DNA, 1305 bp, Magnetospirillum magneticum
  MagA Magnetospirillum magneticum AMB-1 ferrous transporter
tcaaattccagagccaggtccggcattggggtcatccctccaggaaccacgccgcaccagcacacgggcccgccgcgcggtgcgggcgaaagcgcgggcctcgtcgccatacagccgcgtgaccagatcgcggaacgaatggacatgcaccgccgccacccggtgcatgcgccgcatggtgaacagccagaacggcgacagcaccagggacagcacggtgaccgccaccaccagcttggtctcctgggcgctgatcagcttgaccgccttgccggtctcggccagcaggaacgagaactcgccgatctgggccagggccacgccggccaggaaggcgctgggccagtcctgccgcgccaggcgcagcgccgtgacgttcagcgccgtcttgaacagggtcaccatggccagcagggtgagaacggtgcccagattcttccagatgaacttgaagtcgagcagcagcccgatggacaggaagaacaccatcagcagcacgctgccgatgggctgggcacgcttcaacagcatgtcgcgctgggcggaattgcccagcaccacgccgcccaggaaggcgccataggccggcgacaagtccagcacgccggagatggcggcggtgccgaaacaccaggccagggtcgacagggtggcaaggtcagaatcgcgggaaagccgggcggtgatcggcaggtcgatgcggcgcttggacagccaccagaacagcagcaccaggaacagcaccgacagcaccacccgggccatgtcggcgggcagcagcgccttggtctcgaaggattccagcaccagcatcatgggcaccaccgccatgtcctgggcgatcaggatgccaagggtggtgcggccgaccggcgtgtccagctcgtccgaggattccagcaccttgatcactacggcggtggacgacaccgccacggcacagcccagcaccaccgccagccccaggctccagcccaggccgtgacgcagcagcagggccgtgcccacgctgccggcgatctgcagaaccgtggtgaagatggccgtcttccacacttcgagaaagcggatgatgtccagcttcatgccgatgacgaacagcagcatcagcacgccgaactcggccagggtggccacggcgtcgcggttgctcaccagcccgaagccgctgggtcccagcaccacccccgccaggatgtagccgacgacggccggctgcttcaggcgcgtcatcatcccgccgcacagcacggcggccagggcgacgatggcggcataggtcagttcgggatgatgcagttccat

SEQ ID NO: 281 - DNA, 2894 bp, Homo sapiens
  LIGHT or TNFSF14
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaagaaaggaagaaaaaagaaaactcaggaaacagatcttgggggacactccagggaacccaaaactcaaaggcggagagctcagtgggcaccaccaaggcgagatgaagccccagcaggcaccttcagaagacccacgtagactgcagaccctgccacggacaatactaaggacaaaaacccagagacttggggtctgtgggcccccaaacatggggtaaagttgatttgcctgatattcaggaagaaggggtgaggggtgggtatttatgcttttgattcagaagaaagtggggcttgggattccagggacttggctgggggtgggaaacttcatccacttccctactctcatcatgagtacggacagggtgggcgggagactgatcatcgggactcatcatgaagagcccagccccaccccacatactcagatcccacccacagactggtggccacacctcagcctggtcacaaagagttacactcagatacatgagcacggcagcgtgctcataactgtttaacaaccagctgtcctgggagggggacagctttgtaatgtttgccaatttccatggtgtaaatgctaccaccatggctgatttcatcactgccaagcatagacatccctaataggacaccacggatctgtccccggcatccggcccagggcctggcacaaagcatgctctagggaaatgcttgctgattgaaaggaaggaagaatgactctacagtcacacctatggcatcccacaaaatctgtcacatggctgcataatctcagccactctttcacaactatagactcatacacgcgaagtgccagattcatgcacaaccacacaatcacatggaagtcacagacggcatcacagacagtcacagcactgtgtgtatgttataacacaagcacacaaaactcagacagcatcccagctacacagccactcccagaggtgtcaccgtcacacttggtaattaatactcattacattagacacagacagaccaagttatagtcagacctggttacacacatacacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctgga

SEQ ID NO: 282 - DNA, 900 bp, Mus musculus
  Mouse PEDF
atgcaggccctggtgctactcctctggactggagccctgctcgggcacggcagcagccagaacgtccccagcagctctgagggctccccagtcccggacagcacgggcgagcccgtggaggaggaggaccccttcttcaaggtccctgtgaacaagctggcagcagctgtctccaacttcggctacgatctgtaccgcctgagatccggtgccagcccaacgggcaacgtcctgctgtctccactcagcgtggccacggccctctctgccctttctctgggagctgaacatcgaacagagtctgtcattcaccgggctctctactacgacctgatcaccaaccctgacatccacagcacctacaaggagctccttgcctctgttactgcccctgagaagaacctcaagcgtgcttccagaattgtgtttgagaggaaacttcgagtcaaatccagctttgttgcccctctggagaagtcctatgggaccaggccccggatcctcacgggcaaccctcgagtagaccttcaggagattaacaactgggtgcaggcccagatgaaagggaagattgcccggtccacgagggaaatgcccagtgccctcagcatccttctccttggcgtggcttacttcaaggggcagtgggtaaccaagtttgactcgagaaagacgaccctccaggattttcatttggacgaggacaggaccgtgagagtccccatgatgtcagatcctaaggccatcttacgatacggcttggactctgatctcaactgcaagattgcccagctgcccttgacaggaagtatgagcatcatcttcttcctgcccctgaccgtgacccagaacttgaccatgatagaagagagcctcacctctgagttcattcatgacatc

SEQ ID NO: 283 - DNA, 707 bp, Artificial Sequence
  TurboFP635
gtaccacccactcctatcgcacgactagtggctcttgtacgtgtactttgacatgtacctcccgtggcacttgctggtggtgaagttcacgtgtaggctcccgcttccgttcgggatgctcccgtgggtctggtacttctagttccaccagctcccgccgggagaggggaagcggaagctgtaggaccgatggtcgaagtacatgccgtcgttttggaaatagttggtgtgggtcccgtaggggctgaagaaattcgtcaggaagggactcccgaagtgtaccctctcctagtggtgtatgcttctgcccccgcacgactggcgatgggtcctgtggtcggaggtcttgccgacggagtagatgttgcagttctagttgccccacttgaagggtaggttgccgggacactacgtcttcttttgtgagccgaccctccggtcgtggctctacgacatggggcgactgtcgccggactctccggtatcggtctaccgggacttcgagcacccgcccccgatggacgtgacgagggagttctggtgtatgtctaggttctttgggcgattcttggagttctacgggccgaagatgaagcacctgtcctctgacctttcttagttcctccggctgtttctctggatgcagctcgtcgtgctctaccgacaccggtccatgacgctggacggatcgtttgaccccgtgtcga

SEQ ID NO: 284 - DNA, 966 bp, Artificial Sequence
  IFP (Infrared fluorescent protein)
atgagtagagaccccctgcctttctttccacctctgtacctgggaggaccagagatcaccacagaaaactgcgagagggaacccatccacattcctggctcaattcagcctcatggggccctgctgaccgctgatggacactcaggcgaagtgctgcaggtgagcctgaatgccgctacattcctgggacaggagcctacagtgctgaggggacagactctggctgctctgctgccagaacagtggccagctctgcaggctgctctgccaccaggatgtccagacgccctgcagtatagggctactctggattggccagctgctggacacctgtctctgaccgtgcatcgggtggccgaactgctgatcctggagttcgaacccaccgaggcctgggactccattgggcctcacgctctgagaaacgccatgtttgctctggagtctgccccaaatctgagggctctggccgaagtggccacacagactgtgcgggagctgacaggcttcgacagagtgatgctgtacaagtttgcccccgatgctactggggagatgatcgctgaagcccggagagagggaatgcaggccttcctgggccacagatttcctgctagccataccccagctcaggccagggctctgtatacaaggcacctgctgaggctgaccgctgacacaagggctgctgctgtgcctctggatccagtgctgaaccctcagactaatgctccaaccccactgggaggagctgtgctgcgcgctacttccccaatgcatatgcagtacctgcggaacatgggcgtggggagctccctgtctgtgagtgtggtggtgggaggacagctgtggggactgattgtgtgccaccatcagacaccctatgtgctgcctccagatctgaggactaccctggaggaactgggaaggaagctgtccggacaggtgcagcggaaagaggcctga

SEQ ID NO: 285 - DNA, 522 bp, Artificial Sequence
  FTL 498-499InsTC (mutated form of the ferritin light chain)
atgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaagcttatcaagaagatgggtgaccacctgaccaacctccacaggctgggtggcccggaggctgggctgggcgagtatctctcttcgaaaggctcactctcaagcacgactag

SEQ ID NO: 286 - DNA, 507 bp, Artificial Sequence; identical to SEQ ID NO: 91
  A34R gene from VACV IHD-J

SEQ ID NO: 287 - DNA, 829 bp, Homo sapiens
  Mitochondrial MnSOD
gctgtggtggcttcggcagcggcttcagcagatcggcggcatcagcggtaagccagcactagcagcatgttgagccgggcagtgtgcggcaccagcaggcagctggctccggctttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataagcaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctgggtacatactgaaac

SEQ ID NO: 288 - DNA, 1513 bp, Homo sapiens
  Human alcohol dehydrogenase 1A
aagcaaaaaaaataaataaatacctatgcaatacacctgctttatgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatgatggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaaccattcaaaaaaaaaaaaa

SEQ ID NO: 289 - DNA, 1965 bp, Homo sapiens
  nHIS (nonfunctional variant)
atggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagctgtctgggaggctgacccccagttctccccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctga

SEQ ID NO: 290 - DNA, 477 bp, Artificial Sequence
  Bacterioferritin (codon optimized)
atgaagggcgacaccaaggtgatcaactacctgaacaagctgctgggcaacgaactggtggccatcaaccagtactttctgcacgcccggatgttcaagaactggggcctgaagcggctgaacgacgtggagtaccacgagagcatcgacgagatgaagcacgccgaccggtacatcgagagaatcctgtttctggaaggcctgcccaacctgcaggacctgggcaagctgaacatcggcgaggacgtggaggaaatgctgcggagcgacctggccctggaactggacggcgccaagaacctgcgggaggccatcggctacgccgacagcgtgcacgactacgtgagccgggacatgatgatcgagatcctgcgggacgaggaaggccacatcgactggctggaaaccgagctggacctgatccagaagatgggcctgcagaactacctgcaggcccagatccgggaggaaggctga

SEQ ID NO: 291 - DNA, 87 bp, Artificial Sequence
  pre-miRNA 181a (sequence inserted into viral genome)
ggttgcttcagtgaacattcaacgctgtcggtgagtttggaattcaaataaaaaccatcgaccgttgattgtaccctatagctaacc

SEQ ID NO: 292 - DNA, 23 bp, Artificial Sequence
  miRNA 181a
aacattcaacgctgtcggtgagt

SEQ ID NO: 293 - RNA, 23 nt, Artificial Sequence
  mmu-miR-181a MIMAT0000210 mature miRNA 181a
aacauucaacgcugucggugagu

SEQ ID NO: 294 - DNA, 85 bp, Artificial Sequence
  pre-miRNA 126 (sequence inserted into the viral genome)
cgctggcgacgggacattattacttttggtacgcgctgtgacacttcaaactcgtaccgtgagtaataatgcgccgtccacggca

SEQ ID NO: 295 - DNA, 22 bp, Artificial Sequence
  miRNA 126
tcgtaccgtgagtaataatgcg

SEQ ID NO: 296 - RNA, 85 nt, Artificial Sequence
  hsa-miR-126 MI000471
cgcuggcgacgggacauuauuacuuuugguacgcgcugugacacuucaaacucguaccgugaguaauaaugcgccguccacggca

SEQ ID NO: 297 - RNA, 22 nt, Artificial Sequence
  hsa-miR-126 MIMAT0000445
ucguaccgugaguaauaaugcg

SEQ ID NO: 298 - DNA, 94 bp, Artificial Sequence
  pre-miRNA 335 (sequence inserted into the viral genome)
tgttttgagcgggggtcaagagcaataacgaaaaatgtttgtcataaaccgtttttcattattgctcctgacctcctctcatttgctatattca

SEQ ID NO: 299 - DNA, 23 bp, Artificial Sequence
  miRNA 335
tcaagagcaataacgaaaaatgt

SEQ ID NO: 300 - RNA, 94 nt, Artificial Sequence
  hsa-miR-335 MI0000816
uguuuugagcgggggucaagagcaauaacgaaaaauguuugucauaaaccguuuuucauuauugcuccugaccuccucucauuugcuauauuca

SEQ ID NO: 301 - RNA, 23 nt, Artificial Sequence
  hsa-miR-335 MIMAT0000765
ucaagagcaauaacgaaaaaugu

SEQ ID NO: 302 - DNA, 816 bp, Artificial Sequence
  GLAF-3
atggagacagacacactcctgctatgggtactgctgctctgggttccaggttccactggtgacgaggtccaactggtggagtcagggggagggctggtccagcctggagggtccctgaggctctcctgtgcagcctctggattcactttcaccgacaactggatttcctgggttcgccaggccccgggcaagggcctggagtgggtcggatacattagcccaaactccggtttcacctactacgccgactcagtcaagggacgattcaccatctccgccgacacctccaagaacaccgcctacctgcaaatgaacagcctgagggccgaggacacggccgtgtattactgtgcaagggacaacttcggtggatacttcgactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaaccacgtactactgtcaacaaagctacaccggaactgtcaccttcgggcaagggaccaaggttgagattaagcgagactacaaggatgacgacgacaagtaa

SEQ ID NO: 303 - DNA, 6364 bp, Artificial Sequence
  pTK-pSE-GLAF-3
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactttcaccgacaactggatttcctgggttcgccaggccccgggcaagggcctggagtgggtcggatacattagcccaaactccggtttcacctactacgccgactcagtcaagggacgattcaccatctccgccgacacctccaagaacaccgcctacctgcaaatgaacagcctgagggccgaggacacggccgtgtattactgtgcaagggacaacttcggtggatacttcgactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaaccacgtactactgtcaacaaagctacaccggaactgtcaccttcgggcaagggaccaaggttgagattaagcgagactacaaggatgacgacgacaagtaattaat

SEQ ID NO: 304 - DNA, 6402 bp, Artificial Sequence
  pTK-pSEL-GLAF-3
acctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactttcaccgacaactggatttcctgggttcgccaggccccgggcaagggcctggagtgggtcggatacattagcccaaactccggtttcacctactacgccgactcagtcaagggacgattcaccatctccgccgacacctccaagaacaccgcctacctgcaaatgaacagcctgagggccgaggacacggccgtgtattactgtgcaagggacaacttcggtggatacttcgactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaaccacgtactactgtcaacaaagctacaccggaactgtcaccttcgggcaagggaccaaggttgagattaagcgagactacaaggatgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacat

SEQ ID NO: 305 - DNA, 6365 bp, Artificial Sequence
  pTK-pSL-GLAF-3
cagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactttcaccgacaactggatttcctgggttcgccaggccccgggcaagggcctggagtgggtcggatacattagcccaaactccggtttcacctactacgccgactcagtcaagggacgattcaccatctccgccgacacctccaagaacaccgcctacctgcaaatgaacagcctgagggccgaggacacggccgtgtattactgtgcaagggacaacttcggtggatacttcgactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaaccacgtactactgtcaacaaagctacaccggaactgtcaccttcgggcaagggaccaaggttgagattaagcgagactacaaggatgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgc

SEQ ID NO: 306 - DNA, 831 bp, Artificial Sequence
  GLAF-4
atggaaaccgacaccctgctgctgtgggtgctgctgctctgggtcccaggtagcaccggcgatcaggtgcagctgaagcagtctggcgccgagctggtcaagcctggcgctagcgtgaagctgagctgcaagaccagcggctacaccttcaccgagaacatcatccactgggtcaagcagcggagcggccagggcctggaatggatcggctggttccaccctggcagcggcagcatcaagtacaacgagaagaaggacaaggccaccctgaccgccgacaagagcagtagcaccgtgtacatggaactgagccggctgaccagcgaggacagcgccgtgtacttctgcgccagacacggcggcacaggcagaggcgccatggattattggggccagggcaccagcgtgaccgtgtctagcggtggaggcggatctggcggcggaggatctgggggaggcggcagcgacatcctgatgacacagagccccgccagcagcgtggtgtctctgtctggccagcgggccaccatcagctgcagagccagcaagagcgtgtccaccagcgcctacagctacatgcactggtatcagcagaagcccggccagccccccaagctgctgatctacctggccagcaacctggaaagcggcgtgccccccagattcagcggctctggctccggcaccgacttcaccctgaacatccaccccgtggaagaagaggacgccgccacctactactgccagcacagcagagagctgccctacaccttcggcggaggcaccaagctggaaatcaagcgggactacaaggacgacgacgacaagtaa

SEQ ID NO: 307 - DNA, 6379 bp, Artificial Sequence
  pTK-pSE-GLAF-4
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgacccaccatggaaaccgacaccctgctgctgtgggtgctgctgctctgggtcccaggtagcaccggcgatcaggtgcagctgaagcagtctggcgccgagctggtcaagcctggcgctagcgtgaagctgagctgcaagaccagcggctacaccttcaccgagaacatcatccactgggtcaagcagcggagcggccagggcctggaatggatcggctggttccaccctggcagcggcagcatcaagtacaacgagaagaaggacaaggccaccctgaccgccgacaagagcagtagcaccgtgtacatggaactgagccggctgaccagcgaggacagcgccgtgtacttctgcgccagacacggcggcacaggcagaggcgccatggattattggggccagggcaccagcgtgaccgtgtctagcggtggaggcggatctggcggcggaggatctgggggaggcggcagcgacatcctgatgacacagagccccgccagcagcgtggtgtctctgtctggccagcgggccaccatcagctgcagagccagcaagagcgtgtccaccagcgcctacagctacatgcactggtatcagcagaagcccggccagccccccaagctgctgatctacctggccagcaacctggaaagcggcgtgccccccagattcagcggctctggctccggcaccgacttcaccctgaacatccaccccgtggaagaagaggacgccgccacctactactgccagcacagcagagagctgccctacaccttcggcggaggcaccaagctggaaatcaagcgggactacaaggacgacgacgacaagtaattaat

SEQ ID NO: 308 - DNA, 6417 bp, Artificial Sequence
  pTK-pSEL-GLAF-4
acctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacccaccatggaaaccgacaccctgctgctgtgggtgctgctgctctgggtcccaggtagcaccggcgatcaggtgcagctgaagcagtctggcgccgagctggtcaagcctggcgctagcgtgaagctgagctgcaagaccagcggctacaccttcaccgagaacatcatccactgggtcaagcagcggagcggccagggcctggaatggatcggctggttccaccctggcagcggcagcatcaagtacaacgagaagaaggacaaggccaccctgaccgccgacaagagcagtagcaccgtgtacatggaactgagccggctgaccagcgaggacagcgccgtgtacttctgcgccagacacggcggcacaggcagaggcgccatggattattggggccagggcaccagcgtgaccgtgtctagcggtggaggcggatctggcggcggaggatctgggggaggcggcagcgacatcctgatgacacagagccccgccagcagcgtggtgtctctgtctggccagcgggccaccatcagctgcagagccagcaagagcgtgtccaccagcgcctacagctacatgcactggtatcagcagaagcccggccagccccccaagctgctgatctacctggccagcaacctggaaagcggcgtgccccccagattcagcggctctggctccggcaccgacttcaccctgaacatccaccccgtggaagaagaggacgccgccacctactactgccagcacagcagagagctgccctacaccttcggcggaggcaccaagctggaaatcaagcgggactacaaggacgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacat

SEQ ID NO: 309 - DNA, 6380 bp, Artificial Sequence
  pTK-pSL-GLAF-4
cagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacccaccatggaaaccgacaccctgctgctgtgggtgctgctgctctgggtcccaggtagcaccggcgatcaggtgcagctgaagcagtctggcgccgagctggtcaagcctggcgctagcgtgaagctgagctgcaagaccagcggctacaccttcaccgagaacatcatccactgggtcaagcagcggagcggccagggcctggaatggatcggctggttccaccctggcagcggcagcatcaagtacaacgagaagaaggacaaggccaccctgaccgccgacaagagcagtagcaccgtgtacatggaactgagccggctgaccagcgaggacagcgccgtgtacttctgcgccagacacggcggcacaggcagaggcgccatggattattggggccagggcaccagcgtgaccgtgtctagcggtggaggcggatctggcggcggaggatctgggggaggcggcagcgacatcctgatgacacagagccccgccagcagcgtggtgtctctgtctggccagcgggccaccatcagctgcagagccagcaagagcgtgtccaccagcgcctacagctacatgcactggtatcagcagaagcccggccagccccccaagctgctgatctacctggccagcaacctggaaagcggcgtgccccccagattcagcggctctggctccggcaccgacttcaccctgaacatccaccccgtggaagaagaggacgccgccacctactactgccagcacagcagagagctgccctacaccttcggcggaggcaccaagctggaaatcaagcgggactacaaggacgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgc

SEQ ID NO: 310 - DNA, 828 bp, Artificial Sequence
  GLAF-5
atggaaaccgacaccctgctgctgtgggtgctgctgctctgggtcccaggtagcaccggcgatgaggtgcagctggtggaaagtggcggaggcctggtgcagcctggcggaagcctgagactgagctgtgccgccagcggctacaccttcaccgagaacatcatccactgggtccgacaggcccctggcaagggcctggaatgggtggcctggttccaccctggcagcggcagcatcaagtacaacgagaagaaggaccggttcaccatcagcgccgacaccagcaagaacaccgcctacctgcagatgaacagcctgcgggccgaggacaccgccgtgtactactgtgcccggcacggcggaacaggcagaggcgccatggactattggggccagggcaccctggtcaccgtgtctagcggtggaggcggatctggcggcggaggatcagggggaggcggcagcgacatccagatgacccagagccccagcagcctgagcgccagcgtgggcgacagagtgaccatcacctgtcgggccagcaagagcgtgtccaccagcgcctacagctacatgcactggtatcagcagaagcccggcaaggcccccaagctgctgatctacctggccagcaacctggaatccggcgtgcccagccggtttagcggctctggctccggcaccgacttcaccctgaccatcagcagcctgcagcccgaggatttcgccacctactactgccagcacagcagagagctgccctacaccttcggacagggcaccaaggtggaaatcaagcgggactacaaggacgacgacgacaagtaa

SEQ ID NO: 311 - DNA, 6376 bp, Artificial Sequence
  pTK-pSE-GLAF-5
taatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgacccaccatggaaaccgacaccctgctgctgtgggtgctgctgctctgggtcccaggtagcaccggcgatgaggtgcagctggtggaaagtggcggaggcctggtgcagcctggcggaagcctgagactgagctgtgccgccagcggctacaccttcaccgagaacatcatccactgggtccgacaggcccctggcaagggcctggaatgggtggcctggttccaccctggcagcggcagcatcaagtacaacgagaagaaggaccggttcaccatcagcgccgacaccagcaagaacaccgcctacctgcagatgaacagcctgcgggccgaggacaccgccgtgtactactgtgcccggcacggcggaacaggcagaggcgccatggactattggggccagggcaccctggtcaccgtgtctagcggtggaggcggatctggcggcggaggatcagggggaggcggcagcgacatccagatgacccagagccccagcagcctgagcgccagcgtgggcgacagagtgaccatcacctgtcgggccagcaagagcgtgtccaccagcgcctacagctacatgcactggtatcagcagaagcccggcaaggcccccaagctgctgatctacctggccagcaacctggaatccggcgtgcccagccggtttagcggctctggctccggcaccgacttcaccctgaccatcagcagcctgcagcccgaggatttcgccacctactactgccagcacagcagagagctgccctacaccttcggacagggcaccaaggtggaaatcaagcgggactacaaggacgacgacgacaagtaattaat

SEQ ID NO: 312 - DNA, 6414 bp, Artificial Sequence
  pTK-pSEL-GLAF-5
acctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgacccaccatggaaaccgacaccctgctgctgtgggtgctgctgctctgggtcccaggtagcaccggcgatgaggtgcagctggtggaaagtggcggaggcctggtgcagcctggcggaagcctgagactgagctgtgccgccagcggctacaccttcaccgagaacatcatccactgggtccgacaggcccctggcaagggcctggaatgggtggcctggttccaccctggcagcggcagcatcaagtacaacgagaagaaggaccggttcaccatcagcgccgacaccagcaagaacaccgcctacctgcagatgaacagcctgcgggccgaggacaccgccgtgtactactgtgcccggcacggcggaacaggcagaggcgccatggactattggggccagggcaccctggtcaccgtgtctagcggtggaggcggatctggcggcggaggatcagggggaggcggcagcgacatccagatgacccagagccccagcagcctgagcgccagcgtgggcgacagagtgaccatcacctgtcgggccagcaagagcgtgtccaccagcgcctacagctacatgcactggtatcagcagaagcccggcaaggcccccaagctgctgatctacctggccagcaacctggaatccggcgtgcccagccggtttagcggctctggctccggcaccgacttcaccctgaccatcagcagcctgcagcccgaggatttcgccacctactactgccagcacagcagagagctgccctacaccttcggacagggcaccaaggtggaaatcaagcgggactacaaggacgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacat

SEQ ID NO: 313 - DNA, 6377 bp, Artificial Sequence
  pTK-pSL-GLAF-5
cagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacccaccatggaaaccgacaccctgctgctgtgggtgctgctgctctgggtcccaggtagcaccggcgatgaggtgcagctggtggaaagtggcggaggcctggtgcagcctggcggaagcctgagactgagctgtgccgccagcggctacaccttcaccgagaacatcatccactgggtccgacaggcccctggcaagggcctggaatgggtggcctggttccaccctggcagcggcagcatcaagtacaacgagaagaaggaccggttcaccatcagcgccgacaccagcaagaacaccgcctacctgcagatgaacagcctgcgggccgaggacaccgccgtgtactactgtgcccggcacggcggaacaggcagaggcgccatggactattggggccagggcaccctggtcaccgtgtctagcggtggaggcggatctggcggcggaggatcagggggaggcggcagcgacatccagatgacccagagccccagcagcctgagcgccagcgtgggcgacagagtgaccatcacctgtcgggccagcaagagcgtgtccaccagcgcctacagctacatgcactggtatcagcagaagcccggcaaggcccccaagctgctgatctacctggccagcaacctggaatccggcgtgcccagccggtttagcggctctggctccggcaccgacttcaccctgaccatcagcagcctgcagcccgaggatttcgccacctactactgccagcacagcagagagctgccctacaccttcggacagggcaccaaggtggaaatcaagcgggactacaaggacgacgacgacaagtaatattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgc

SEQ ID NO: 314 - DNA, 2121 bp, Artificial Sequence
  luxAB
atgaagttcggcaactttctgctgacctaccagcccccccagttcagccagaccgaggtgatgaagcggctggtgaagctgggccggatcagcgaggaatgcggcttcgacaccgtgtggctgctggaacaccacttcaccgagttcggcctgctgggcaacccctacgtggctgccgcctacctgctgggcgccaccaagaaactgaacgtgggcaccgccgccatcgtgctgcccaccgcccaccccgtgcggcagctggaagatgtgaacctgctggaccagatgagcaagggccggttccggttcggcatctgtaggggcctgtacaacaaggacttccgggtgttcggcaccgacatgaacaacagcagagccctggccgagtgctggtacggcctgatcaagaacggcgtgaccgagggctacatggaagccgacaacgagcacatcaagttccacaaggtgaaagtgaaccctgccgcctacagcagaggcggagcccccgtgtacgtggtggccgagagcgccagcaccaccgagtgggctgcccagtttggcctgcccatgatcctgagctggatcatcaacaccaacgagaagaaggcccagctggaactgtacaacgaggtggcccaggaatacggccacgacatccacaacatcgaccactgcctgagctacatcaccagcgtggaccacgacagcatcaaggccaaagagatctgccggaagttcctgggccattggtacgacagctacgtgaacgccaccaccatcttcgacgacagcgaccagacccggggctacgacttcaacaagggccagtggcgggacttcgtgctgaagggccacaaggacaccaaccggcggatcgactacagctacgagatcaaccccgtgggcacccctcaggaatgcatcgacatcatccagaaggacatcgacgccaccggcatcagcaacatctgctgcggctttgaggccaacggcaccgtggacgagatcattgccagcatgaagctgttccagagcgacgtgatgcccttcctgaaagagaagcagcggagcctgctgtacgccaccaacttctccctgctgaagcaggccggcgacgtggaggagaaccccggccccatgaaattcggcctgttcttcctgaacttcatcaactccaccaccgtgcaggaacagagcatcgtccggatgcaggaaatcaccgagtacgtggacaagctgaacttcgagcagatcctggtgtacgagaaccacttcagcgacaacggcgtggtgggagcccctctgaccgtgagcggcttcctgctgggcctgaccgagaagatcaagatcggcagcctgaaccacatcatcaccacccaccaccccgtgaggatcgccgaggaagcctgcctgctggatcagctgtccgagggcagattcatcctgggcttcagcgactgtgagaagaaagacgagatgcacttcttcaaccggcccgtggagtaccagcagcagctgttcgaggaatgctatgagatcatcaacgacgccctgaccaccggctactgcaaccccgacaacgacttctacagcttccccaagatcagcgtgaacccccacgcctacacccctggcggccctcggaagtacgtgaccgccacaagccaccacatcgtggaatgggccgccaagaagggcatccctctgatcttcaagtgggacgacagcaacgacgtgagatacgagtacgccgagcggtacaaggctgccgccgacaagtacgacgtggacctgagcgagattgatcaccagctgatgatcctggtgaactacaacgaggactccaacaaggccaagcaggaaacccgggccttcatcagcgactacgtgctggaaatgcaccccaacgagaacttcgagaacaagctcgaagagatcattgctgagaacgccgtgggcaactacaccgagtgcatcacagccgccaagctggccatcgagaagtgcggcgccaagagcgtgctgctgtccttcgagcccatgaacgacctgatgagccagaaaaacgtgatcaacatcgtggacgacaacatcaagaaataccacatgaagtacacatga

SEQ ID NO: 315 - DNA, 7668 bp, Artificial Sequence
  pTK-PSE-luxAB
aagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgagtcgaccaccatgaagttcggcaactttctgctgacctaccagcccccccagttcagccagaccgaggtgatgaagcggctggtgaagctgggccggatcagcgaggaatgcggcttcgacaccgtgtggctgctggaacaccacttcaccgagttcggcctgctgggcaacccctacgtggctgccgcctacctgctgggcgccaccaagaaactgaacgtgggcaccgccgccatcgtgctgcccaccgcccaccccgtgcggcagctggaagatgtgaacctgctggaccagatgagcaagggccggttccggttcggcatctgtaggggcctgtacaacaaggacttccgggtgttcggcaccgacatgaacaacagcagagccctggccgagtgctggtacggcctgatcaagaacggcgtgaccgagggctacatggaagccgacaacgagcacatcaagttccacaaggtgaaagtgaaccctgccgcctacagcagaggcggagcccccgtgtacgtggtggccgagagcgccagcaccaccgagtgggctgcccagtttggcctgcccatgatcctgagctggatcatcaacaccaacgagaagaaggcccagctggaactgtacaacgaggtggcccaggaatacggccacgacatccacaacatcgaccactgcctgagctacatcaccagcgtggaccacgacagcatcaaggccaaagagatctgccggaagttcctgggccattggtacgacagctacgtgaacgccaccaccatcttcgacgacagcgaccagacccggggctacgacttcaacaagggccagtggcgggacttcgtgctgaagggccacaaggacaccaaccggcggatcgactacagctacgagatcaaccccgtgggcacccctcaggaatgcatcgacatcatccagaaggacatcgacgccaccggcatcagcaacatctgctgcggctttgaggccaacggcaccgtggacgagatcattgccagcatgaagctgttccagagcgacgtgatgcccttcctgaaagagaagcagcggagcctgctgtacgccaccaacttctccctgctgaagcaggccggcgacgtggaggagaaccccggccccatgaaattcggcctgttcttcctgaacttcatcaactccaccaccgtgcaggaacagagcatcgtccggatgcaggaaatcaccgagtacgtggacaagctgaacttcgagcagatcctggtgtacgagaaccacttcagcgacaacggcgtggtgggagcccctctgaccgtgagcggcttcctgctgggcctgaccgagaagatcaagatcggcagcctgaaccacatcatcaccacccaccaccccgtgaggatcgccgaggaagcctgcctgctggatcagctgtccgagggcagattcatcctgggcttcagcgactgtgagaagaaagacgagatgcacttcttcaaccggcccgtggagtaccagcagcagctgttcgaggaatgctatgagatcatcaacgacgccctgaccaccggctactgcaaccccgacaacgacttctacagcttccccaagatcagcgtgaacccccacgcctacacccctggcggccctcggaagtacgtgaccgccacaagccaccacatcgtggaatgggccgccaagaagggcatccctctgatcttcaagtgggacgacagcaacgacgtgagatacgagtacgccgagcggtacaaggctgccgccgacaagtacgacgtggacctgagcgagattgatcaccagctgatgatcctggtgaactacaacgaggactccaacaaggccaagcaggaaacccgggccttcatcagcgactacgtgctggaaatgcaccccaacgagaacttcgagaacaagctcgaagagatcattgctgagaacgccgtgggcaactacaccgagtgcatcacagccgccaagctggccatcgagaagtgcggcgccaagagcgtgctgctgtccttcgagcccatgaacgacctgatgagccagaaaaacgtgatcaacatcgtggacgacaacatcaagaaataccacatgaagtacacatgattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgcc

SEQ ID NO: 316 - DNA, 7698 bp, Artificial Sequence
  pTK-PSEL-luxAB
tagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgaccaccatgaagttcggcaactttctgctgacctaccagcccccccagttcagccagaccgaggtgatgaagcggctggtgaagctgggccggatcagcgaggaatgcggcttcgacaccgtgtggctgctggaacaccacttcaccgagttcggcctgctgggcaacccctacgtggctgccgcctacctgctgggcgccaccaagaaactgaacgtgggcaccgccgccatcgtgctgcccaccgcccaccccgtgcggcagctggaagatgtgaacctgctggaccagatgagcaagggccggttccggttcggcatctgtaggggcctgtacaacaaggacttccgggtgttcggcaccgacatgaacaacagcagagccctggccgagtgctggtacggcctgatcaagaacggcgtgaccgagggctacatggaagccgacaacgagcacatcaagttccacaaggtgaaagtgaaccctgccgcctacagcagaggcggagcccccgtgtacgtggtggccgagagcgccagcaccaccgagtgggctgcccagtttggcctgcccatgatcctgagctggatcatcaacaccaacgagaagaaggcccagctggaactgtacaacgaggtggcccaggaatacggccacgacatccacaacatcgaccactgcctgagctacatcaccagcgtggaccacgacagcatcaaggccaaagagatctgccggaagttcctgggccattggtacgacagctacgtgaacgccaccaccatcttcgacgacagcgaccagacccggggctacgacttcaacaagggccagtggcgggacttcgtgctgaagggccacaaggacaccaaccggcggatcgactacagctacgagatcaaccccgtgggcacccctcaggaatgcatcgacatcatccagaaggacatcgacgccaccggcatcagcaacatctgctgcggctttgaggccaacggcaccgtggacgagatcattgccagcatgaagctgttccagagcgacgtgatgcccttcctgaaagagaagcagcggagcctgctgtacgccaccaacttctccctgctgaagcaggccggcgacgtggaggagaaccccggccccatgaaattcggcctgttcttcctgaacttcatcaactccaccaccgtgcaggaacagagcatcgtccggatgcaggaaatcaccgagtacgtggacaagctgaacttcgagcagatcctggtgtacgagaaccacttcagcgacaacggcgtggtgggagcccctctgaccgtgagcggcttcctgctgggcctgaccgagaagatcaagatcggcagcctgaaccacatcatcaccacccaccaccccgtgaggatcgccgaggaagcctgcctgctggatcagctgtccgagggcagattcatcctgggcttcagcgactgtgagaagaaagacgagatgcacttcttcaaccggcccgtggagtaccagcagcagctgttcgaggaatgctatgagatcatcaacgacgccctgaccaccggctactgcaaccccgacaacgacttctacagcttccccaagatcagcgtgaacccccacgcctacacccctggcggccctcggaagtacgtgaccgccacaagccaccacatcgtggaatgggccgccaagaagggcatccctctgatcttcaagtgggacgacagcaacgacgtgagatacgagtacgccgagcggtacaaggctgccgccgacaagtacgacgtggacctgagcgagattgatcaccagctgatgatcctggtgaactacaacgaggactccaacaaggccaagcaggaaacccgggccttcatcagcgactacgtgctggaaatgcaccccaacgagaacttcgagaacaagctcgaagagatcattgctgagaacgccgtgggcaactacaccgagtgcatcacagccgccaagctggccatcgagaagtgcggcgccaagagcgtgctgctgtccttcgagcccatgaacgacctgatgagccagaaaaacgtgatcaacatcgtggacgacaacatcaagaaataccacatgaagtacacatgattaattaatttttatcgatctaattcaacaatgtctggagagctcttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattc

SEQ ID NO: 317 - DNA, 2424 bp, Artificial Sequence
  luxCD
atgacaaagaagatcagcttcatcatcaacggccaggtggagatcttccccgagggcgacgacctggtgcagagcatcaacttcggcgacaactccgtgtacctgcccatcctgaacgactcccacgtgaagaacatcatcgactgcaacggcaacaacgagctgcggctgcacaacatcgtgaactttctgtacaccgtgggccagcggtggaagaacgaggaatacagccggcggaggacctacatccgggacctgaagaaatacatgggctacagcgaggaaatggccaaactggaagccaactggatcagcatgatcctgtgcagcaagggcggcctgtacgatgtcgtggagaacgagctgggcagccggcacatcatggacgagtggctgccccaggacgagagctacgtgcgcgccttccccaagggcaagtccgtgcacctgctggccggcaacgtgcccctgagcggcatcatgagcatcctgcgggccatcctgaccaagaaccagtgcatcatcaagaccagcagcaccgaccccttcaccgccaacgccctggccctgagcttcattgacgtggaccccaaccaccccatcacccggtccctgagcgtgatctactggccccaccagggcgacaccagcctggccaaagaaatcatgcagcacgccgacgtgatcgtggcctggggcggacctgacgccatcaactgggccgtggagcacgcccccagctatgccgatgtgatcaagttcggctccaagaaaagcctgtgcatcatcgacaaccctgtggacctgaccagcgccgccacaggggccgctcacgacgtgtgcttctacgaccagcgggcctgctttagcgcccagaacatctactacatgggcaatcactacgaggaattcaagctggccctgatcgaaaagctgaacctgtacgcccacatcctgcccaatgccaagaaggatttcgacgagaaggccgcctactctctggtgcagaaagagagcctgttcgccggcctgaaggtggaggtggacatccaccagagatggatgatcatcgagagcaacgccggcgtggagttcaaccagcccctgggcagatgtgtgtacctgcaccatgtggacaacatcgagcagattctgccctacgtgcagaagaacaagacccagaccatcagcatcttcccttgggagagcagcttcaagtaccgggatgccctcgccctgaagggcgccgagcggatcgtggaggccggcatgaacaatatcttcagagtgggcggctctcacgacggcaccaggcccctccagaggctggtgacctacatcagccacgagcggcccagcaattacaccgccaaggacgtggccgtggagatcgagcagacccggttcctggaagaggacaagttcctggtgttcgtgccccagtgcaccaactacgccctcctgaaactggctggcgatgtcgagagcaaccctggacctatggaaaacgagagcaagtacaagaccatcgaccacgtgatctgcgtggagggcaacaagaaaatccacgtgtgggagacactgcccgaggaaaacagccccaagcggaagaacgccatcatcattgcctccggcttcgccaggcggatggaccactttgccggcctggccgaatacctgagccggaacggcttccacgtgatcagatacgactctctgcaccacgtgggcctgagcagcggcaccatcgacgagttcaccatgagcatcggcaagcagtctctgctggccgtggtggactggctgaccacccggaagatcaacaacttcggcatgctggcctccagcctgagcgcccggatcgcctacgccagcctgtccgagatcaacgcctccttcctgatcaccgccgtgggcgtggtgaacctgcggtacagcctggaaagagccctgggcttcgactacctgagcctgcccatcaatgagctgcccaacaacctggacttcgagggccacaaactgggcgccgaggtgttcgcccgggactgcctggatttcggctgggaggacctggccagcaccatcaacaacatgatgtacctggacatccctttcattgcctttaccgccaacaacgacaactgggtgaagcaggacgaggtgatcaccctgctgtccaacatccggtccaaccggtgcaagatctactccctgctgggctccagccacgatctgagcgagaacctggtggtgctgcggaacttctaccagagcgtgaccaaggccgccattgccatggacaacgaccacctggatatcgacgtggacatcaccgagcccagcttcgagcacctgaccattgccaccgtgaacgagcggcggatgcggatcgagatcgagaaccaggccatctccctgtcctga

SEQ ID NO: 318 - DNA, 6355 bp, Artificial Sequence
  pHA-PSE-luxCD
tagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcggtttggaattagtgaaagcttaaaaattgaaaaactagcgtctttttttgctcgaagctcgaagtcgaccaccatgacaaagaagatcagcttcatcatcaacggccaggtggagatcttccccgagggcgacgacctggtgcagagcatcaacttcggcgacaactccgtgtacctgcccatcctgaacgactcccacgtgaagaacatcatcgactgcaacggcaacaacgagctgcggctgcacaacatcgtgaactttctgtacaccgtgggccagcggtggaagaacgaggaatacagccggcggaggacctacatccgggacctgaagaaatacatgggctacagcgaggaaatggccaaactggaagccaactggatcagcatgatcctgtgcagcaagggcggcctgtacgatgtcgtggagaacgagctgggcagccggcacatcatggacgagtggctgccccaggacgagagctacgtgcgcgccttccccaagggcaagtccgtgcacctgctggccggcaacgtgcccctgagcggcatcatgagcatcctgcgggccatcctgaccaagaaccagtgcatcatcaagaccagcagcaccgaccccttcaccgccaacgccctggccctgagcttcattgacgtggaccccaaccaccccatcacccggtccctgagcgtgatctactggccccaccagggcgacaccagcctggccaaagaaatcatgcagcacgccgacgtgatcgtggcctggggcggacctgacgccatcaactgggccgtggagcacgcccccagctatgccgatgtgatcaagttcggctccaagaaaagcctgtgcatcatcgacaaccctgtggacctgaccagcgccgccacaggggccgctcacgacgtgtgcttctacgaccagcgggcctgctttagcgcccagaacatctactacatgggcaatcactacgaggaattcaagctggccctgatcgaaaagctgaacctgtacgcccacatcctgcccaatgccaagaaggatttcgacgagaaggccgcctactctctggtgcagaaagagagcctgttcgccggcctgaaggtggaggtggacatccaccagagatggatgatcatcgagagcaacgccggcgtggagttcaaccagcccctgggcagatgtgtgtacctgcaccatgtggacaacatcgagcagattctgccctacgtgcagaagaacaagacccagaccatcagcatcttcccttgggagagcagcttcaagtaccgggatgccctcgccctgaagggcgccgagcggatcgtggaggccggcatgaacaatatcttcagagtgggcggctctcacgacggcaccaggcccctccagaggctggtgacctacatcagccacgagcggcccagcaattacaccgccaaggacgtggccgtggagatcgagcagacccggttcctggaagaggacaagttcctggtgttcgtgccccagtgcaccaactacgccctcctgaaactggctggcgatgtcgagagcaaccctggacctatggaaaacgagagcaagtacaagaccatcgaccacgtgatctgcgtggagggcaacaagaaaatccacgtgtgggagacactgcccgaggaaaacagccccaagcggaagaacgccatcatcattgcctccggcttcgccaggcggatggaccactttgccggcctggccgaatacctgagccggaacggcttccacgtgatcagatacgactctctgcaccacgtgggcctgagcagcggcaccatcgacgagttcaccatgagcatcggcaagcagtctctgctggccgtggtggactggctgaccacccggaagatcaacaacttcggcatgctggcctccagcctgagcgcccggatcgcctacgccagcctgtccgagatcaacgcctccttcctgatcaccgccgtgggcgtggtgaacctgcggtacagcctggaaagagccctgggcttcgactacctgagcctgcccatcaatgagctgcccaacaacctggacttcgagggccacaaactgggcgccgaggtgttcgcccgggactgcctggatttcggctgggaggacctggccagcaccatcaacaacatgatgtacctggacatccctttcattgcctttaccgccaacaacgacaactgggtgaagcaggacgaggtgatcaccctgctgtccaacatccggtccaaccggtgcaagatctactccctgctgggctccagccacgatctgagcgagaacctggtggtgctgcggaacttctaccagagcgtgaccaaggccgccattgccatggacaacgaccacctggatatcgacgtggacatcaccgagcccagcttcgagcacctgaccattgccaccgtgaacgagcggcggatgcggatcgagatcgagaaccaggccatctccctgtcctgattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattc

SEQ ID NO: 319 - DNA, 6361 bp, Artificial Sequence
  pHA-PSEL-luxCD
tagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcggtttggaattagtgaaagcttaaaaattgaaattttattttttttttttggaatataaataagctcgaagtcgaccaccatgacaaagaagatcagcttcatcatcaacggccaggtggagatcttccccgagggcgacgacctggtgcagagcatcaacttcggcgacaactccgtgtacctgcccatcctgaacgactcccacgtgaagaacatcatcgactgcaacggcaacaacgagctgcggctgcacaacatcgtgaactttctgtacaccgtgggccagcggtggaagaacgaggaatacagccggcggaggacctacatccgggacctgaagaaatacatgggctacagcgaggaaatggccaaactggaagccaactggatcagcatgatcctgtgcagcaagggcggcctgtacgatgtcgtggagaacgagctgggcagccggcacatcatggacgagtggctgccccaggacgagagctacgtgcgcgccttccccaagggcaagtccgtgcacctgctggccggcaacgtgcccctgagcggcatcatgagcatcctgcgggccatcctgaccaagaaccagtgcatcatcaagaccagcagcaccgaccccttcaccgccaacgccctggccctgagcttcattgacgtggaccccaaccaccccatcacccggtccctgagcgtgatctactggccccaccagggcgacaccagcctggccaaagaaatcatgcagcacgccgacgtgatcgtggcctggggcggacctgacgccatcaactgggccgtggagcacgcccccagctatgccgatgtgatcaagttcggctccaagaaaagcctgtgcatcatcgacaaccctgtggacctgaccagcgccgccacaggggccgctcacgacgtgtgcttctacgaccagcgggcctgctttagcgcccagaacatctactacatgggcaatcactacgaggaattcaagctggccctgatcgaaaagctgaacctgtacgcccacatcctgcccaatgccaagaaggatttcgacgagaaggccgcctactctctggtgcagaaagagagcctgttcgccggcctgaaggtggaggtggacatccaccagagatggatgatcatcgagagcaacgccggcgtggagttcaaccagcccctgggcagatgtgtgtacctgcaccatgtggacaacatcgagcagattctgccctacgtgcagaagaacaagacccagaccatcagcatcttcccttgggagagcagcttcaagtaccgggatgccctcgccctgaagggcgccgagcggatcgtggaggccggcatgaacaatatcttcagagtgggcggctctcacgacggcaccaggcccctccagaggctggtgacctacatcagccacgagcggcccagcaattacaccgccaaggacgtggccgtggagatcgagcagacccggttcctggaagaggacaagttcctggtgttcgtgccccagtgcaccaactacgccctcctgaaactggctggcgatgtcgagagcaaccctggacctatggaaaacgagagcaagtacaagaccatcgaccacgtgatctgcgtggagggcaacaagaaaatccacgtgtgggagacactgcccgaggaaaacagccccaagcggaagaacgccatcatcattgcctccggcttcgccaggcggatggaccactttgccggcctggccgaatacctgagccggaacggcttccacgtgatcagatacgactctctgcaccacgtgggcctgagcagcggcaccatcgacgagttcaccatgagcatcggcaagcagtctctgctggccgtggtggactggctgaccacccggaagatcaacaacttcggcatgctggcctccagcctgagcgcccggatcgcctacgccagcctgtccgagatcaacgcctccttcctgatcaccgccgtgggcgtggtgaacctgcggtacagcctggaaagagccctgggcttcgactacctgagcctgcccatcaatgagctgcccaacaacctggacttcgagggccacaaactgggcgccgaggtgttcgcccgggactgcctggatttcggctgggaggacctggccagcaccatcaacaacatgatgtacctggacatccctttcattgcctttaccgccaacaacgacaactgggtgaagcaggacgaggtgatcaccctgctgtccaacatccggtccaaccggtgcaagatctactccctgctgggctccagccacgatctgagcgagaacctggtggtgctgcggaacttctaccagagcgtgaccaaggccgccattgccatggacaacgaccacctggatatcgacgtggacatcaccgagcccagcttcgagcacctgaccattgccaccgtgaacgagcggcggatgcggatcgagatcgagaaccaggccatctccctgtcctgattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattc

SEQ ID NO: 320 - DNA, 1113 bp, Artificial Sequence
  luxE
atgaccagctacgtggataagcaggaaattaccgccagcagcgagatcgacgacctgatcttcagcagcgaccccctcgtgtggagctacgacgagcaggaaaagatccggaagaaactggtgctggacgccttccggaaccactacaagcactgccgggagtaccggcactactgccaggcccacaaggtggacgataatatcaccgagattgacgacatccccgtgttccccacctccgtgttcaagttcacccggctgctgaccagccaggaaaatgagatcgagagctggttcaccagctccggcaccaacggcctgaagagccaggtggcccgggacagactgagcatcgagcggctgctgggcagcgtgagctacggcatgaagtacgtgggcagctggttcgaccaccagatcgagctggtcaacctgggacccgaccggttcaacgcccacaatatctggttcaagtacgtgatgagcctggtggagctgctgtaccctaccacctttaccgtgaccgaagagcgcatcgacttcgtgaaaaccctgaactccctggaacggatcaagaaccagggcaaggacctgtgcctgatcggctccccctacttcatctacctgctgtgccactacatgaaggacaagaagatctccttcagcggcgacaagagcctgtatatcatcacaggcggcggatggaagagctacgagaaagagtccctgaagcgggacgacttcaaccacctgctgttcgacaccttcaacctgagcgacatctcccagatccgggacatcttcaaccaggccgagctgaatacctgcttcttcgaggatgagatgcagcggaagcacgtgcccccctgggtgtacgccagagccctggaccccgagacactgaagcccgtgcccgacggcacccctggcctgatgagctacatggacgccagcgccacctcctaccccgccttcatcgtgacccacgatgtgggcatcatcagcagagagtacggcaagtaccccggcgtgctggtcgagatcctgcggcgggtgaacacccggacccagaaaggctgcgccctgtccctgaccgaggccttcgacagctga

SEQ ID NO: 321 - DNA, 5270 bp, Artificial Sequence
  pF14.5L-PSE-luxE (reverse direction)
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagacattgttgaattagatcgataaaaattaattaatcagctgtcgaaggcctcggtcagggacagggcgcagcctttctgggtccgggtgttcacccgccgcaggatctcgaccagcacgccggggtacttgccgtactctctgctgatgatgcccacatcgtgggtcacgatgaaggcggggtaggaggtggcgctggcgtccatgtagctcatcaggccaggggtgccgtcgggcacgggcttcagtgtctcggggtccagggctctggcgtacacccaggggggcacgtgcttccgctgcatctcatcctcgaagaagcaggtattcagctcggcctggttgaagatgtcccggatctgggagatgtcgctcaggttgaaggtgtcgaacagcaggtggttgaagtcgtcccgcttcagggactctttctcgtagctcttccatccgccgcctgtgatgatatacaggctcttgtcgccgctgaaggagatcttcttgtccttcatgtagtggcacagcaggtagatgaagtagggggagccgatcaggcacaggtccttgccctggttcttgatccgttccagggagttcagggttttcacgaagtcgatgcgctcttcggtcacggtaaaggtggtagggtacagcagctccaccaggctcatcacgtacttgaaccagatattgtgggcgttgaaccggtcgggtcccaggttgaccagctcgatctggtggtcgaaccagctgcccacgtacttcatgccgtagctcacgctgcccagcagccgctcgatgctcagtctgtcccgggccacctggctcttcaggccgttggtgccggagctggtgaaccagctctcgatctcattttcctggctggtcagcagccgggtgaacttgaacacggaggtggggaacacggggatgtcgtcaatctcggtgatattatcgtccaccttgtgggcctggcagtagtgccggtactcccggcagtgcttgtagtggttccggaaggcgtccagcaccagtttcttccggatcttttcctgctcgtcgtagctccacacgagggggtcgctgctgaagatcaggtcgtcgatctcgctgctggcggtaatttcctgcttatccacgtagctggtcatggtggtcgacttcgagcaaaaaaagacgctagtttttcaatttttgagctcggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 322 - DNA, 5287 bp, Artificial Sequence
  pF14.5L-PSEL-luxE (reverse direction)
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagagattgttgaattagatcgataaaaattaattaatcagctgtcgaaggcctcggtcagggacagggcgcagcctttctgggtccgggtgttcacccgccgcaggatctcgaccagcacgccggggtacttgccgtactctctgctgatgatgcccacatcgtgggtcacgatgaaggcggggtaggaggtggcgctggcgtccatgtagctcatcaggccaggggtgccgtcgggcacgggcttcagtgtctcggggtccagggctctggcgtacacccaggggggcacgtgcttccgctgcatctcatcctcgaagaagcaggtattcagctcggcctggttgaagatgtcccggatctgggagatgtcgctcaggttgaaggtgtcgaacagcaggtggttgaagtcgtcccgcttcagggactctttctcgtagctcttccatccgccgcctgtgatgatatacaggctcttgtcgccgctgaaggagatcttcttgtccttcatgtagtggcacagcaggtagatgaagtagggggagccgatcaggcacaggtccttgccctggttcttgatccgttccagggagttcagggttttcacgaagtcgatgcgctcttcggtcacggtaaaggtggtagggtacagcagctccaccaggctcatcacgtacttgaaccagatattgtgggcgttgaaccggtcgggtcccaggttgaccagctcgatctggtggtcgaaccagctgcccacgtacttcatgccgtagctcacgctgcccagcagccgctcgatgctcagtctgtcccgggccacctggctcttcaggccgttggtgccggagctggtgaaccagctctcgatctcattttcctggctggtcagcagccgggtgaacttgaacacggaggtggggaacacggggatgtcgtcaatctcggtgatattatcgtccaccttgtgggcctggcagtagtgccggtactcccggcagtgcttgtagtggttccggaaggcgtccagcaccagtttcttccggatcttttcctgctcgtcgtagctccacacgagggggtcgctgctgaagatcaggtcgtcgatctcgctgctggcggtaatttcctgcttatccacgtagctggtcatggtggtcgacttcgagcttatttatattccaaaaaaaaaaaataaaatttcaatttttaagcttcgcaggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 323 - DNA, 5786 bp, Artificial Sequence
  luxABCDE
gctcgaagtcgaccatgaagttcggcaactttctgctgacctaccagcccccccagttcagccagaccgaggtgatgaagcggctggtgaagctgggccggatcagcgaggaatgcggcttcgacaccgtgtggctgctggaacaccacttcaccgagttcggcctgctgggcaacccctacgtggctgccgcctacctgctgggcgccaccaagaaactgaacgtgggcaccgccgccatcgtgctgcccaccgcccaccccgtgcggcagctggaagatgtgaacctgctggaccagatgagcaagggccggttccggttcggcatctgtaggggcctgtacaacaaggacttccgggtgttcggcaccgacatgaacaacagcagagccctggccgagtgctggtacggcctgatcaagaacggcgtgaccgagggctacatggaagccgacaacgagcacatcaagttccacaaggtgaaagtgaaccctgccgcctacagcagaggcggagcccccgtgtacgtggtggccgagagcgccagcaccaccgagtgggctgcccagtttggcctgcccatgatcctgagctggatcatcaacaccaacgagaagaaggcccagctggaactgtacaacgaggtggcccaggaatacggccacgacatccacaacatcgaccactgcctgagctacatcaccagcgtggaccacgacagcatcaaggccaaagagatctgccggaagttcctgggccattggtacgacagctacgtgaacgccaccaccatcttcgacgacagcgaccagacccggggctacgacttcaacaagggccagtggcgggacttcgtgctgaagggccacaaggacaccaaccggcggatcgactacagctacgagatcaaccccgtgggcacccctcaggaatgcatcgacatcatccagaaggacatcgacgccaccggcatcagcaacatctgctgcggctttgaggccaacggcaccgtggacgagatcattgccagcatgaagctgttccagagcgacgtgatgcccttcctgaaagagaagcagcggagcctgctgtacgccaccaacttctccctgctgaagcaggccggcgacgtggaggagaaccccggccccatgaaattcggcctgttcttcctgaacttcatcaactccaccaccgtgcaggaacagagcatcgtccggatgcaggaaatcaccgagtacgtggacaagctgaacttcgagcagatcctggtgtacgagaaccacttcagcgacaacggcgtggtgggagcccctctgaccgtgagcggcttcctgctgggcctgaccgagaagatcaagatcggcagcctgaaccacatcatcaccacccaccaccccgtgaggatcgccgaggaagcctgcctgctggatcagctgtccgagggcagattcatcctgggcttcagcgactgtgagaagaaagacgagatgcacttcttcaaccggcccgtggagtaccagcagcagctgttcgaggaatgctatgagatcatcaacgacgccctgaccaccggctactgcaaccccgacaacgacttctacagcttccccaagatcagcgtgaacccccacgcctacacccctggcggccctcggaagtacgtgaccgccacaagccaccacatcgtggaatgggccgccaagaagggcatccctctgatcttcaagtgggacgacagcaacgacgtgagatacgagtacgccgagcggtacaaggctgccgccgacaagtacgacgtggacctgagcgagattgatcaccagctgatgatcctggtgaactacaacgaggactccaacaaggccaagcaggaaacccgggccttcatcagcgactacgtgctggaaatgcaccccaacgagaacttcgagaacaagctcgaagagatcattgctgagaacgccgtgggcaactacaccgagtgcatcacagccgccaagctggccatcgagaagtgcggcgccaagagcgtgctgctgtccttcgagcccatgaacgacctgatgagccagaaaaacgtgatcaacatcgtggacgacaacatcaagaaataccacatgaagtacacagagggcagaggcagcctgctcacctgcggagacgtcgaagagaatcctgggcccatgacaaagaagatcagcttcatcatcaacggccaggtggagatcttccccgagggcgacgacctggtgcagagcatcaacttcggcgacaactccgtgtacctgcccatcctgaacgactcccacgtgaagaacatcatcgactgcaacggcaacaacgagctgcggctgcacaacatcgtgaactttctgtacaccgtgggccagcggtggaagaacgaggaatacagccggcggaggacctacatccgggacctgaagaaatacatgggctacagcgaggaaatggccaaactggaagccaactggatcagcatgatcctgtgcagcaagggcggcctgtacgatgtcgtggagaacgagctgggcagccggcacatcatggacgagtggctgccccaggacgagagctacgtgcgcgccttccccaagggcaagtccgtgcacctgctggccggcaacgtgcccctgagcggcatcatgagcatcctgcgggccatcctgaccaagaaccagtgcatcatcaagaccagcagcaccgaccccttcaccgccaacgccctggccctgagcttcattgacgtggaccccaaccaccccatcacccggtccctgagcgtgatctactggccccaccagggcgacaccagcctggccaaagaaatcatgcagcacgccgacgtgatcgtggcctggggcggacctgacgccatcaactgggccgtggagcacgcccccagctatgccgatgtgatcaagttcggctccaagaaaagcctgtgcatcatcgacaaccctgtggacctgaccagcgccgccacaggggccgctcacgacgtgtgcttctacgaccagcgggcctgctttagcgcccagaacatctactacatgggcaatcactacgaggaattcaagctggccctgatcgaaaagctgaacctgtacgcccacatcctgcccaatgccaagaaggatttcgacgagaaggccgcctactctctggtgcagaaagagagcctgttcgccggcctgaaggtggaggtggacatccaccagagatggatgatcatcgagagcaacgccggcgtggagttcaaccagcccctgggcagatgtgtgtacctgcaccatgtggacaacatcgagcagattctgccctacgtgcagaagaacaagacccagaccatcagcatcttcccttgggagagcagcttcaagtaccgggatgccctcgccctgaagggcgccgagcggatcgtggaggccggcatgaacaatatcttcagagtgggcggctctcacgacggcaccaggcccctccagaggctggtgacctacatcagccacgagcggcccagcaattacaccgccaaggacgtggccgtggagatcgagcagacccggttcctggaagaggacaagttcctggtgttcgtgccccagtgcaccaactacgccctcctgaaactggctggcgatgtcgagagcaaccctggacctatggaaaacgagagcaagtacaagaccatcgaccacgtgatctgcgtggagggcaacaagaaaatccacgtgtgggagacactgcccgaggaaaacagccccaagcggaagaacgccatcatcattgcctccggcttcgccaggcggatggaccactttgccggcctggccgaatacctgagccggaacggcttccacgtgatcagatacgactctctgcaccacgtgggcctgagcagcggcaccatcgacgagttcaccatgagcatcggcaagcagtctctgctggccgtggtggactggctgaccacccggaagatcaacaacttcggcatgctggcctccagcctgagcgcccggatcgcctacgccagcctgtccgagatcaacgcctccttcctgatcaccgccgtgggcgtggtgaacctgcggtacagcctggaaagagccctgggcttcgactacctgagcctgcccatcaatgagctgcccaacaacctggacttcgagggccacaaactgggcgccgaggtgttcgcccgggactgcctggatttcggctgggaggacctggccagcaccatcaacaacatgatgtacctggacatccctttcattgcctttaccgccaacaacgacaactgggtgaagcaggacgaggtgatcaccctgctgtccaacatccggtccaaccggtgcaagatctactccctgctgggctccagccacgatctgagcgagaacctggtggtgctgcggaacttctaccagagcgtgaccaaggccgccattgccatggacaacgaccacctggatatcgacgtggacatcaccgagcccagcttcgagcacctgaccattgccaccgtgaacgagcggcggatgcggatcgagatcgagaaccaggccatctccctgtccgtgaaacagactttgaattttgacctgctcaagctcgcaggggacgtggagtccaacccagggccaatgaccagctacgtggataagcaggaaattaccgccagcagcgagatcgacgacctgatcttcagcagcgaccccctcgtgtggagctacgacgagcaggaaaagatccggaagaaactggtgctggacgccttccggaaccactacaagcactgccgggagtaccggcactactgccaggcccacaaggtggacgataatatcaccgagattgacgacatccccgtgttccccacctccgtgttcaagttcacccggctgctgaccagccaggaaaatgagatcgagagctggttcaccagctccggcaccaacggcctgaagagccaggtggcccgggacagactgagcatcgagcggctgctgggcagcgtgagctacggcatgaagtacgtgggcagctggttcgaccaccagatcgagctggtcaacctgggacccgaccggttcaacgcccacaatatctggttcaagtacgtgatgagcctggtggagctgctgtaccctaccacctttaccgtgaccgaagagcgcatcgacttcgtgaaaaccctgaactccctggaacggatcaagaaccagggcaaggacctgtgcctgatcggctccccctacttcatctacctgctgtgccactacatgaaggacaagaagatctccttcagcggcgacaagagcctgtatatcatcacaggcggcggatggaagagctacgagaaagagtccctgaagcgggacgacttcaaccacctgctgttcgacaccttcaacctgagcgacatctcccagatccgggacatcttcaaccaggccgagctgaatacctgcttcttcgaggatgagatgcagcggaagcacgtgcccccctgggtgtacgccagagccctggaccccgagacactgaagcccgtgcccgacggcacccctggcctgatgagctacatggacgccagcgccacctcctaccccgccttcatcgtgacccacgatgtgggcatcatcagcagagagtacggcaagtaccccggcgtgctggtcgagatcctgcggcgggtgaacacccggacccagaaaggctgcgccctgtccctgaccgaggccttcgacagctga

SEQ ID NO: 324 - DNA, 11352 bp, Artificial Sequence
  pTK-PSEL-luxABCDE
tagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacgagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcggtttggaattagtgaaagcttaaaaattgaaattttattttttttttttggaatataaataagctcgaagtcgaccatgaagttcggcaactttctgctgacctaccagcccccccagttcagccagaccgaggtgatgaagcggctggtgaagctgggccggatcagcgaggaatgcggcttcgacaccgtgtggctgctggaacaccacttcaccgagttcggcctgctgggcaacccctacgtggctgccgcctacctgctgggcgccaccaagaaactgaacgtgggcaccgccgccatcgtgctgcccaccgcccaccccgtgcggcagctggaagatgtgaacctgctggaccagatgagcaagggccggttccggttcggcatctgtaggggcctgtacaacaaggacttccgggtgttcggcaccgacatgaacaacagcagagccctggccgagtgctggtacggcctgatcaagaacggcgtgaccgagggctacatggaagccgacaacgagcacatcaagttccacaaggtgaaagtgaaccctgccgcctacagcagaggcggagcccccgtgtacgtggtggccgagagcgccagcaccaccgagtgggctgcccagtttggcctgcccatgatcctgagctggatcatcaacaccaacgagaagaaggcccagctggaactgtacaacgaggtggcccaggaatacggccacgacatccacaacatcgaccactgcctgagctacatcaccagcgtggaccacgacagcatcaaggccaaagagatctgccggaagttcctgggccattggtacgacagctacgtgaacgccaccaccatcttcgacgacagcgaccagacccggggctacgacttcaacaagggccagtggcgggacttcgtgctgaagggccacaaggacaccaaccggcggatcgactacagctacgagatcaaccccgtgggcacccctcaggaatgcatcgacatcatccagaaggacatcgacgccaccggcatcagcaacatctgctgcggctttgaggccaacggcaccgtggacgagatcattgccagcatgaagctgttccagagcgacgtgatgcccttcctgaaagagaagcagcggagcctgctgtacgccaccaacttctccctgctgaagcaggccggcgacgtggaggagaaccccggccccatgaaattcggcctgttcttcctgaacttcatcaactccaccaccgtgcaggaacagagcatcgtccggatgcaggaaatcaccgagtacgtggacaagctgaacttcgagcagatcctggtgtacgagaaccacttcagcgacaacggcgtggtgggagcccctctgaccgtgagcggcttcctgctgggcctgaccgagaagatcaagatcggcagcctgaaccacatcatcaccacccaccaccccgtgaggatcgccgaggaagcctgcctgctggatcagctgtccgagggcagattcatcctgggcttcagcgactgtgagaagaaagacgagatgcacttcttcaaccggcccgtggagtaccagcagcagctgttcgaggaatgctatgagatcatcaacgacgccctgaccaccggctactgcaaccccgacaacgacttctacagcttccccaagatcagcgtgaacccccacgcctacacccctggcggccctcggaagtacgtgaccgccacaagccaccacatcgtggaatgggccgccaagaagggcatccctctgatcttcaagtgggacgacagcaacgacgtgagatacgagtacgccgagcggtacaaggctgccgccgacaagtacgacgtggacctgagcgagattgatcaccagctgatgatcctggtgaactacaacgaggactccaacaaggccaagcaggaaacccgggccttcatcagcgactacgtgctggaaatgcaccccaacgagaacttcgagaacaagctcgaagagatcattgctgagaacgccgtgggcaactacaccgagtgcatcacagccgccaagctggccatcgagaagtgcggcgccaagagcgtgctgctgtccttcgagcccatgaacgacctgatgagccagaaaaacgtgatcaacatcgtggacgacaacatcaagaaataccacatgaagtacacagagggcagaggcagcctgctcacctgcggagacgtcgaagagaatcctgggcccatgacaaagaagatcagcttcatcatcaacggccaggtggagatcttccccgagggcgacgacctggtgcagagcatcaacttcggcgacaactccgtgtacctgcccatcctgaacgactcccacgtgaagaacatcatcgactgcaacggcaacaacgagctgcggctgcacaacatcgtgaactttctgtacaccgtgggccagcggtggaagaacgaggaatacagccggcggaggacctacatccgggacctgaagaaatacatgggctacagcgaggaaatggccaaactggaagccaactggatcagcatgatcctgtgcagcaagggcggcctgtacgatgtcgtggagaacgagctgggcagccggcacatcatggacgagtggctgccccaggacgagagctacgtgcgcgccttccccaagggcaagtccgtgcacctgctggccggcaacgtgcccctgagcggcatcatgagcatcctgcgggccatcctgaccaagaaccagtgcatcatcaagaccagcagcaccgaccccttcaccgccaacgccctggccctgagcttcattgacgtggaccccaaccaccccatcacccggtccctgagcgtgatctactggccccaccagggcgacaccagcctggccaaagaaatcatgcagcacgccgacgtgatcgtggcctggggcggacctgacgccatcaactgggccgtggagcacgcccccagctatgccgatgtgatcaagttcggctccaagaaaagcctgtgcatcatcgacaaccctgtggacctgaccagcgccgccacaggggccgctcacgacgtgtgcttctacgaccagcgggcctgctttagcgcccagaacatctactacatgggcaatcactacgaggaattcaagctggccctgatcgaaaagctgaacctgtacgcccacatcctgcccaatgccaagaaggatttcgacgagaaggccgcctactctctggtgcagaaagagagcctgttcgccggcctgaaggtggaggtggacatccaccagagatggatgatcatcgagagcaacgccggcgtggagttcaaccagcccctgggcagatgtgtgtacctgcaccatgtggacaacatcgagcagattctgccctacgtgcagaagaacaagacccagaccatcagcatcttcccttgggagagcagcttcaagtaccgggatgccctcgccctgaagggcgccgagcggatcgtggaggccggcatgaacaatatcttcagagtgggcggctctcacgacggcaccaggcccctccagaggctggtgacctacatcagccacgagcggcccagcaattacaccgccaaggacgtggccgtggagatcgagcagacccggttcctggaagaggacaagttcctggtgttcgtgccccagtgcaccaactacgccctcctgaaactggctggcgatgtcgagagcaaccctggacctatggaaaacgagagcaagtacaagaccatcgaccacgtgatctgcgtggagggcaacaagaaaatccacgtgtgggagacactgcccgaggaaaacagccccaagcggaagaacgccatcatcattgcctccggcttcgccaggcggatggaccactttgccggcctggccgaatacctgagccggaacggcttccacgtgatcagatacgactctctgcaccacgtgggcctgagcagcggcaccatcgacgagttcaccatgagcatcggcaagcagtctctgctggccgtggtggactggctgaccacccggaagatcaacaacttcggcatgctggcctccagcctgagcgcccggatcgcctacgccagcctgtccgagatcaacgcctccttcctgatcaccgccgtgggcgtggtgaacctgcggtacagcctggaaagagccctgggcttcgactacctgagcctgcccatcaatgagctgcccaacaacctggacttcgagggccacaaactgggcgccgaggtgttcgcccgggactgcctggatttcggctgggaggacctggccagcaccatcaacaacatgatgtacctggacatccctttcattgcctttaccgccaacaacgacaactgggtgaagcaggacgaggtgatcaccctgctgtccaacatccggtccaaccggtgcaagatctactccctgctgggctccagccacgatctgagcgagaacctggtggtgctgcggaacttctaccagagcgtgaccaaggccgccattgccatggacaacgaccacctggatatcgacgtggacatcaccgagcccagcttcgagcacctgaccattgccaccgtgaacgagcggcggatgcggatcgagatcgagaaccaggccatctccctgtccgtgaaacagactttgaattttgacctgctcaagctcgcaggggacgtggagtccaacccagggccaatgaccagctacgtggataagcaggaaattaccgccagcagcgagatcgacgacctgatcttcagcagcgaccccctcgtgtggagctacgacgagcaggaaaagatccggaagaaactggtgctggacgccttccggaaccactacaagcactgccgggagtaccggcactactgccaggcccacaaggtggacgataatatcaccgagattgacgacatccccgtgttccccacctccgtgttcaagttcacccggctgctgaccagccaggaaaatgagatcgagagctggttcaccagctccggcaccaacggcctgaagagccaggtggcccgggacagactgagcatcgagcggctgctgggcagcgtgagctacggcatgaagtacgtgggcagctggttcgaccaccagatcgagctggtcaacctgggacccgaccggttcaacgcccacaatatctggttcaagtacgtgatgagcctggtggagctgctgtaccctaccacctttaccgtgaccgaagagcgcatcgacttcgtgaaaaccctgaactccctggaacggatcaagaaccagggcaaggacctgtgcctgatcggctccccctacttcatctacctgctgtgccactacatgaaggacaagaagatctccttcagcggcgacaagagcctgtatatcatcacaggcggcggatggaagagctacgagaaagagtccctgaagcgggacgacttcaaccacctgctgttcgacaccttcaacctgagcgacatctcccagatccgggacatcttcaaccaggccgagctgaatacctgcttcttcgaggatgagatgcagcggaagcacgtgcccccctgggtgtacgccagagccctggaccccgagacactgaagcccgtgcccgacggcacccctggcctgatgagctacatggacgccagcgccacctcctaccccgccttcatcgtgacccacgatgtgggcatcatcagcagagagtacggcaagtaccccggcgtgctggtcgagatcctgcggcgggtgaacacccggacccagaaaggctgcgccctgtccctgaccgaggccttcgacagctgattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattc

SEQ ID NO: 325 - DNA, 4626 bp, Artificial Sequence
  pHA-PSE-frp
aaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcaaaaattgaaaaactagcgtctttttttgctcgaagtcgacccaccatgaacaatacgattgaaaccattcttgctcatcgctctatccgaaaattcaccgcagttcctattactgatgaacaaagacaaaccatcattcaagcaggtttagctgcgtcttcttctagtatgcttcaagtcgtctcaatcgttcgagtgactgactctgaaaagcgtaacgaattggctcaatttgctggtaaccaagcttatgttgaaagtgcggctgagttcttagtgttttgtattgattatcagcgccatgcaaccatcaatcctgatgtacaggcagactttacagaactaactctgattggagcagtagattctggaatcatggcacaaaactgcttgcttgcagccgagtctatgggattaggtggcgtatatattggaggactaaggaatagcgcagctcaagttgatgagctattgggcttaccggaaaatagcgcggtgttgtttggtatgtgcttagggcatcccgatcaaaatcccgaagtaaagccacgcctacctgcacatgtggttgttcatgaaaatcaataccaagagctaaatttagatgatattcagagctacgatcaaactatgcaagcgtattatgcgagccgtacaagcaatcaaaaactgagtacatggtcgcaagaagtcactgggaagcttgctggtgagtcgcgacctcatattctgccgtacttgaacagtaaggggctagcaaaacgctaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcat

SEQ ID NO: 326 - DNA, 194908 bp, Vaccinia virus
  GLV-1h64
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgaagtcgacgccaccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagatgggtaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcttttttttttttttttttttggcatataaataagtcgacccaccatggagacagacacactcctgctatgggtactgctgctctgggttccaggttccactggtgacgaggtccaactggtggagtcagggggagggctggtccagcctggagggtccctgaggctctcctgtgcagcctctggattcactatcagcgactactggatccactgggttcgccaggccccgggcaagggcctggagtgggtcgcaggaatcaccccagccggtggttacacctactacgccgactcagtcaagggacgattcaccatctccgccgacacctccaagaacaccgcctacctgcaaatgaacagcctgagggccgaggacacggccgtgtattactgtgcaaggttcgtgttcttcctgccatatgccatggactactggggccaagggaccctggtcaccgtctcctcaggtggtggcggttcaggcggaggtggctctggcggtggcggatcggacattcagatgacccagtctccaagctccctgtccgctagcgtcggagacagggtcactatcacttgcagagcttcccaggacgtctccactgcagtggcatggtaccagcagaagccagggaaggcaccaaagctccttatttactcagcaagcttcctttactccggagtcccatcccgattcagcggcagcggcagtggcacagattttaccctcacaatttcaagcctccaaccagaggatttcgcaacctactactgtcaacaaggctacggcaacccattcaccttcgggcaagggaccaaggttgagattaagcgataattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 327 - DNA, 1828 bp, Artificial Sequence
  Wild-type cdc6 (inserted in the A46R locus of GLV-1h236)
ggatccaaaaattgaaaaactagcgtctttttttgctcgaccaccatgtctgcagggaaggagctaaagtattatagaaataaatggagacagacttctggcatcatacaagtttgtgtggccatcatgcctcaaaccagatcccagacacaagctaccatcggttttccgaaaaagaagctatctaataccctgaagaaacccaattcccgggattgtgaagtaaaacttagaaacgtccagcctgtacccaccactccgtgtgtggacgtaaaacttctgcctctcagtccccgaaaacgtctgggcgatgacaacctgtgcaacactccccggttatctccctgttctccaccaaagctgggcaagaaagaaaacggaccccctcgctcacatacgtggaaggggtgcagattagtattcgatgatgagccgacatttaaggcttcccccccaaaagaacaagacagagttcgccaacaccagatacgttcctcctccgctcaaagaagtccagagagcaaagcagatcctgagcagaaatgtccgccggagaaggagtctgtgtgtataagactgttcaagcaagaaggcacttgctatcagcaagccaagctcgtcctgaatacagctgtcccggatcggctgcctgccagagagcaggagatgggtgtcatcaggaattttctgaaggagcacatctgtgggaagaaagctggcagtctctacctttctggcgctcctgggactggaaaaactgcctgtttaagccggattctgcaagacttcaagaaggaagtaaaaggctttaaatccatcctgctgaattgcatgtccctgaggagtgcccaggctgtgttcccagctattgctcaggagattggtcgggaggagctgtgcagaccagctgggaaggacttgatgagaaaactggaaaagcacttgacagcagagaaaggccccatgatcgtgttggtgttggacgagatggatcagctggacagcaaagggcaggatgtattatacacactgtttgagtggccgtggctaagcaactcccgattggtgctcattggtattgctaataccctagatctcacggacagaattctgccgagacttgaagctagagaaaactgtaagccgcagttattgaacttcccaccttataccaggaatcagatagctgccatcttgcaggatcgacttagtcaggtgtcaaaagaccaggttctggacagtgctgcgatccagttctgtgcccgcaaagtgtctgctgtttcaggagacatccgtaaagcgctggatgtttgcaggcgagctatagaaattgtggagtcggatgtcaggagccagacagtcctcaaaccactctccgaatgtaaatcacccagcgagtcgccggtccccaagcgcgttggtcttgctcacatatcccaagtcatttcggaagttgatgggaacagggtgactttgagccaagaaaacacacaggattcccttcctctccagcagaagatcctggtttgctctttgctgcttttgacccggcggctgaaaatcaaagaggtcaccctggggaagttatatgaagcctacagtagcatctgtcgcaaacagcaggtgacggccgtagaccagtctgagtgtttgtccctttcaggactcctggagtccaggggccttgtgggattaaagaaaaataaggagagccgcctcaccaaggtgtctctgaagattgaagaaaaggaaatagagcatgtcctgaacggcaaagctttcaccgggaacatcctcgctgctggtctgccctgatttttatggatcc

SEQ ID NO: 328 - DNA, 1828 bp, Artificial Sequence
  Mutant cdc6 (inserted in the A46R locus of GLV-1h237)
ggatccaaaaattgaaaaactagcgtctttttttgctcgaccaccatgtctgcagggaaggagctaaagtattatagaaataaatggagacagacttctggcatcatacaagtttgtgtggccatcatgcctcaaaccagatcccagacacaagctaccatcggttttccgaaaaagaagctatctaataccctgaagaaacccaattcccgggattgtgaagtaaaacttagaaacgtccagcctgtacccaccactccgtgtgtggacgtaaaacttctgcctctcagtccccgaaaacgtctgggcgatgacaacctgtgcaacactccccggttatctccctgttctccaccaaagctgggcaagaaagaaaacggaccccctcgctcacatacgtggaaggggtgcagattagtattcgatgatgagccgacatttaaggcttcccccccaaaagaacaagacagagttcgccaacaccagatacgttcctcctccgctcaaagaagtccagagagcaaagcagatcctgagcagaaatgtccgccggagaaggagtctgtgtgtataagactgttcaagcaagaaggcacttgctatcagcaagccaagctcgtcctgaatacagctgtcccggatcggctgcctgccagagagcaggagatgggtgtcatcaggaattttctgaaggagcacatctgtgggaagaaagctggcagtctctacctttctggcgctcctgggactggagaaactgcctgtttaagccggattctgcaagacttcaagaaggaagtaaaaggctttaaatccatcctgctgaattgcatgtccctgaggagtgcccaggctgtgttcccagctattgctcaggagattggtcgggaggagctgtgcagaccagctgggaaggacttgatgagaaaactggaaaagcacttgacagcagagaaaggccccatgatcgtgttggtgttggacgagatggatcagctggacagcaaagggcaggatgtattatacacactgtttgagtggccgtggctaagcaactcccgattggtgctcattggtattgctaataccctagatctcacggacagaattctgccgagacttgaagctagagaaaactgtaagccgcagttattgaacttcccaccttataccaggaatcagatagctgccatcttgcaggatcgacttagtcaggtgtcaaaagaccaggttctggacagtgctgcgatccagttctgtgcccgcaaagtgtctgctgtttcaggagacatccgtaaagcgctggatgtttgcaggcgagctatagaaattgtggagtcggatgtcaggagccagacagtcctcaaaccactctccgaatgtaaatcacccagcgagtcgccggtccccaagcgcgttggtcttgctcacatatcccaagtcatttcggaagttgatgggaacagggtgactttgagccaagaaaacacacaggattcccttcctctccagcagaagatcctggtttgctctttgctgcttttgacccggcggctgaaaatcaaagaggtcaccctggggaagttatatgaagcctacagtagcatctgtcgcaaacagcaggtgacggccgtagaccagtctgagtgtttgtccctttcaggactcctggagtccaggggccttgtgggattaaagaaaaataaggagagccgcctcaccaaggtgtctctgaagattgaagaaaaggaaatagagcatgtcctgaacggcaaagctttcaccgggaacatcctcgctgctggtctgccctgatttttatggatcc

SEQ ID NO: 329 - protein, 193 aa, Homo sapiens
  Erythropoietin
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR
